United States Patent
Cowan et al.

(10) Patent No.: US 12,180,263 B2
(45) Date of Patent: Dec. 31, 2024

(54) CELLS LACKING B2M SURFACE EXPRESSION AND METHODS FOR ALLOGENEIC ADMINISTRATION OF SUCH CELLS

(71) Applicant: President and Fellows of Harvard College, Cambridge, MA (US)

(72) Inventors: Chad A. Cowan, Boston, MA (US); Leonardo M. R. Ferreira, Cambridge, MA (US); Torsten B. Meissner, Somerville, MA (US); Jack L Strominger, Cambridge, MA (US)

(73) Assignee: PRESIDENT AND FELLOWS OF HARVARD COLLEGE, Cambridge, MA (US)

( * ) Notice: Subject to any disclaimer, the term of this patent is extended or adjusted under 35 U.S.C. 154(b) by 17 days.

(21) Appl. No.: 15/524,968

(22) PCT Filed: Nov. 6, 2015

(86) PCT No.: PCT/US2015/059621
§ 371 (c)(1),
(2) Date: May 5, 2017

(87) PCT Pub. No.: WO2016/073955
PCT Pub. Date: May 12, 2016

(65) Prior Publication Data
US 2018/0141992 A1 May 24, 2018

Related U.S. Application Data

(60) Provisional application No. 62/076,424, filed on Nov. 6, 2014.

(51) Int. Cl.
| | | |
|---|---|---|
| *C12N 5/0789* | (2010.01) | |
| *A61K 35/12* | (2015.01) | |
| *A61K 35/28* | (2015.01) | |
| *A61P 31/18* | (2006.01) | |
| *C07K 14/74* | (2006.01) | |
| *C12N 9/22* | (2006.01) | |
| *C12N 15/11* | (2006.01) | |
| *C12N 15/113* | (2010.01) | |
| *A61K 48/00* | (2006.01) | |

(52) U.S. Cl.
CPC ........ *C07K 14/70539* (2013.01); *A61K 35/12* (2013.01); *A61K 35/28* (2013.01); *A61P 31/18* (2018.01); *C12N 5/0647* (2013.01); *C12N 9/22* (2013.01); *C12N 15/11* (2013.01); *C12N 15/1138* (2013.01); *A61K 2035/124* (2013.01); *A61K 48/0066* (2013.01); *C12N 2310/10* (2013.01); *C12N 2310/20* (2017.05); *C12N 2510/00* (2013.01)

(58) Field of Classification Search
None
See application file for complete search history.

(56) References Cited

U.S. PATENT DOCUMENTS

| | | |
|---|---|---|
| 6,986,887 B2 | 1/2006 | Lawman et al. |
| 8,013,143 B2 | 9/2011 | Mcswiggen et al. |
| 8,105,831 B2 | 1/2012 | Russell et al. |
| 8,420,395 B2 | 4/2013 | Calos |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 9,822,370 B2 | 11/2017 | Musunuru et al. |
| 2002/0106742 A1 | 8/2002 | Samson et al. |
| 2006/0024819 A1 | 2/2006 | Finney |
| 2008/0188000 A1 | 8/2008 | Reik et al. |
| 2010/0062003 A1 | 3/2010 | Murphy et al. |
| 2010/0076057 A1* | 3/2010 | Sontheimer ........ A61K 31/7088 514/44 A |
| 2010/0093617 A1 | 4/2010 | Barrangou et al. |
| 2010/0227805 A1 | 9/2010 | Karin et al. |
| 2011/0110897 A1 | 5/2011 | Schwarz et al. |
| 2011/0262406 A1 | 10/2011 | Del Campo et al. |

(Continued)

FOREIGN PATENT DOCUMENTS

| | | | | |
|---|---|---|---|---|
| WO | WO-2010015899 A2 * | 2/2010 | ............... | C12N 9/22 |
| WO | WO 2013/016446 | 1/2013 | | |

(Continued)

OTHER PUBLICATIONS

Ribolobis (HLA Engineering of Human Pluripotent Stem Cells. vol. 21, No. 6, pp. 1232-1241 (Year: 2013).*

(Continued)

*Primary Examiner* — Anoop K Singh

(74) *Attorney, Agent, or Firm* — Morse, Barnes-Brown & Pendleton, P.C.; Lisa M. Warren, Esq.; Erin E. Bryan, Esq.

(57) ABSTRACT

Disclosed herein are cells and populations of cells comprising a genome in which the B2M gene has been edited to eliminate surface expression of MHC Class I protein in the cells or population of cells, and methods for allogeneic administration of such cells to reduce the likelihood that the cells will trigger a host immune response when the cells are administered to a subject in need of such cells.

8 Claims, 93 Drawing Sheets

Specification includes a Sequence Listing.

(56) References Cited

U.S. PATENT DOCUMENTS

| | | |
|---|---|---|
| 2011/0300538 A1 | 12/2011 | Barrangou et al. |
| 2012/0088676 A1 | 4/2012 | Weill et al. |
| 2012/0142062 A1 | 6/2012 | Doyon et al. |
| 2012/0192298 A1* | 7/2012 | Weinstein .......... A01K 67/0276 800/14 |
| 2012/0225927 A1 | 9/2012 | Sah et al. |
| 2012/0251618 A1 | 10/2012 | Schrum et al. |
| 2013/0122591 A1 | 5/2013 | Cost et al. |
| 2013/0156849 A1 | 6/2013 | De Fougerolles |
| 2013/0288251 A1 | 10/2013 | Horvath et al. |
| 2013/0330778 A1 | 12/2013 | Zainer et al. |
| 2014/0065667 A1 | 3/2014 | Guschin et al. |
| 2014/0080216 A1 | 3/2014 | Cost et al. |
| 2014/0093913 A1 | 4/2014 | Cost et al. |
| 2014/0134143 A1 | 5/2014 | Baylink et al. |
| 2014/0134195 A1 | 5/2014 | Russell |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang et al. |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273230 A1 | 9/2014 | Chen et al. |
| 2014/0273231 A1 | 9/2014 | Zhang |
| 2014/0273232 A1 | 9/2014 | Zhang et al. |
| 2014/0273233 A1 | 9/2014 | Chen et al. |
| 2014/0273430 A1 | 9/2014 | Zhang et al. |
| 2014/0287938 A1 | 9/2014 | Zhang et al. |
| 2014/0295556 A1 | 10/2014 | Joung et al. |
| 2014/0295557 A1 | 10/2014 | Joung et al. |
| 2014/0301990 A1 | 10/2014 | Gregory et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0335620 A1 | 11/2014 | Zhang et al. |
| 2014/0336133 A1 | 11/2014 | Miller et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349405 A1 | 11/2014 | Sontheimer et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044191 A1 | 2/2015 | Liu et al. |
| 2015/0044192 A1 | 2/2015 | Liu et al. |
| 2015/0056225 A1 | 2/2015 | Russell |
| 2015/0056705 A1 | 2/2015 | Conway et al. |
| 2015/0071889 A1 | 3/2015 | Musunuru et al. |
| 2015/0110762 A1* | 4/2015 | Holmes ................ C12N 15/907 424/93.71 |
| 2015/0152436 A1 | 6/2015 | Musunuru et al. |
| 2015/0166969 A1 | 6/2015 | Takeuchi et al. |
| 2015/0176013 A1 | 6/2015 | Musunuru et al. |
| 2015/0344912 A1 | 12/2015 | Kim et al. |
| 2016/0024524 A1 | 1/2016 | Joung et al. |
| 2016/0185861 A1 | 6/2016 | Bedoya et al. |
| 2019/0032049 A1* | 1/2019 | Naldini .................. A61K 38/45 |
| 2019/0262309 A1* | 8/2019 | Alici ..................... A61K 9/0019 |

FOREIGN PATENT DOCUMENTS

| | | | |
|---|---|---|---|
| WO | WO 2013/126794 | 8/2013 | |
| WO | 2013158292 A1 | 10/2013 | |
| WO | WO 2014/065596 | 5/2014 | |
| WO | WO 2014/093622 | 6/2014 | |
| WO | WO 2014/150624 | 9/2014 | |
| WO | WO 2014/151994 | 9/2014 | |
| WO | WO 2014/153115 | 9/2014 | |
| WO | WO-2014165825 A2 * | 10/2014 | ........... C12N 15/907 |
| WO | WO 2014/204726 | 12/2014 | |
| WO | WO 2015/006498 | 1/2015 | |
| WO | WO 2016/057821 | 4/2016 | |
| WO | WO 2016/057835 | 4/2016 | |
| WO | WO-2016063264 A1 * | 4/2016 | ............. A61K 38/45 |
| WO | WO 2016/073955 A2 | 5/2016 | |
| WO | 2016160721 A1 | 10/2016 | |
| WO | 2017/079673 A1 | 5/2017 | |

OTHER PUBLICATIONS

Gussow et al J. Immunol. 139 (9), 3132-3138 (Year: 1987).*
NCBI accession No. NG_012920.1 , pp. 1-6 (Year: 2013).*
Christianson et al Journal of Immunology, 158: 3578-3586 (Year: 1997).*
Lloyd et al. Front Immunol. 4: 221, 1-7 (Year: 2013).*
Zetsche et al Cell, 163, 759-771, Sep. 25, 2015 (Year: 2015).*
Ma et al PLOS One, 9, 3, e89413, 1-8 (Year: 2014).*
Hsu et al Nat Biotechnol. Sep. 31(9):827-32. (Year: 2013).*
Mandal et al Cell Stem Cell 15, 643-652 (Year: 2014).*
Meissner et al Methods in Enzymology, vol. 546 chapter 13, 273-293 (Year: 2014).*
Sequence alignment between NCBI accession No. NG_012920.2 and SEQ ID No. 1, p. 1-3 (Year: 2018).*
Ma, et al., "Heritable Multiplex Genetic Engineering in Rats Using CRISPR/Cas9," PLOS One, 9(3):1-8, (Mar. 2014).
Meissner, et al., "Genome Editing for Human Gene Therapy," Methods of Enzymology, 546:273-295, (2014).
Chiba et al., "Genome Editing in Human Pluripotent Stem Cells Using Site-Specific Nucleases," *Methods in Molecular Biology*, 1239:267-280, (2015).
Cho, et al., "Targeted Genome Engineering in Human Cells with the Cas9 RNA-Guided Endonuclease," *Nature Biotechnology*, 31(3):230-232, (2013).
Cho, et al., "Targeted Genome Engineering in Human Cells with RNA-Guided Endonucleases," *Supplementary Information, Nature Biotechnology*, pp. 1-11, (2013).
Cho, et al., "Analysis of off-target effects of CRISPR/Cas-derived RNA-guided endonucleases and nickases," *Genome Research*, 24:132-141, (2014).
Christian, et al., "Treating DNA Double-Strand Breaks with TAL Effector Nucleases," *Genetics*, 757-761, (2010).
Cong, et al., "Multiplex Genome Engineering Using CRISPR/Cas Systems," *Science*, 339:819-823, (2013).
Cowan, "Human Cell-Based Models of Primary Adipocyte Disorders," *National Institutes of Health Grant No. 1R01DK095384-01* (Funding Start Date Apr. 1, 2012), Abstract.
Cowan, "Integrating Lipid Genotypes and Phenotypes in IPS Derived Hepatocytes/Adipocytes," *National Institutes of Health Grant No. 1U01HL107440-01* (Funding Start Date Jul. 5, 2011), Abstract.
Cradick, et al., "CRISPR/Cas9 Systems Targeting B-Globin and CCR5 Genes Have Substantial Off-Target Activity," *Nucleic Acids Research*, pp. 1-9, (2013).
Ding, et al., "A TALEN Genome Editing System to Generate Human Stem Cell-Based Disease Models," *Cell Stem Cell*, 12(2):238-251, (2013).
Ding, et al., "Enhanced Efficiency of Human Pluripotent Stem Cell Genome Editing Through Replacing TALENs with CRISPRs," *Cell Stem Cell*, 12:393-394; plus supplemental materials, (2013) (published online on Apr. 4, 2013).
Doudna, et al., "The New Frontier of Genome Engineering With CRISPR-Cas9," *Science*, 346(6213):1077, 1258096-1 through 1258096-9, (2014).

(56) References Cited

OTHER PUBLICATIONS

Edelstein, et al., "Gene Therapy Clinical Trials Worldwide 1989-2004—An Overview," *The Journal of Gene Medicine*, 6:597-602, (2004).
Gaj, et al., "ZFN, TALEN, and CRISPR/Cas-Based Methods for Genome Engineering," *Trends in Biotechnology*, 31(7):397-405, (2013).
GenBank: AY136510.1, Kutlar, et al., "A New Hemoglobin, Beta Chain Variant 'Hb S-Wake' Confirmed to be on the Same Chromosome With Hemoglobin S Mutation, Detected in an African-American Family," Retrieved from the internet on Dec. 23, 2015 < http://www.ncbi.nlm.nih.govlnucleotide/23268448?report=genbanl<&log$=nuclalign&blast_rank=2&RID=7NNHZVRH014>.
GenBank: EF150856.1, Kutlar, et al., "*Homo Sapiens* Beta-Globin (HBB) Gene, HBB-Hb Sickle-Monroe Allele, Exons 1, 2 and Partial cds," Retrieved from the internet on Feb. 22, 2016.http://www.ncbi.nlm.nih.gov/nuccore/EF150856>.
GenBank M13792.1 Human Adenosine Deaminase (ADA) Gene, Complete cds [online] Oct. 4, 1995 [retrieved Oct. 25, 2014]. Available on the internet: <URL: http://www.ncbi.nlm.nih.gov/nuccore/M13792>. Especially p. 17 n\35125-35147 and nt 35090-35112.
Geurts, et al., "Knockout Rats via Embryo Microinjection of Zinc-Finger Nucleases," *Science*, 325:433, (2009).
Gonzalez, et al., "An iCRISPR Platform for Rapid, Multiplexable, and Inducible Genome Editing in Human Pluripotent Stem Cells," *Cell Stem Cell*, 15:215-226, (2014).
Hendel, et al., "Quantifying Genome-Editing Outcomes at Endogenous Loci with SMRT Sequencing," *Cell Reports*, 7: 293-305 (2014).
High, et al., "DNA-Cleaving Enzymes Trigger a Repair Process That Can Now be Harnessed to Correct Mutations in the Human Genome in vitro. This Represents Another Step Towards Gene-Correction Strategies for Treating Human Disease," *Nature*, 435:577 & 579, (2005).
Holt, et al., "Human Hematopietic Stem/Progenitor Cells Modified by Zinc-Finger Nucleases Targeted to CCRG Control HIV-1 in vivo," *Nature Biotechnology*, 28.8:839-847, (2010).
Hruscha, et al., "Efficient CRISPR/Cas9 Genome Editing With Low Off-Target Effects in Zebrafish," *Development*, 140:4982-4987, (2013).
Hsu, et al., "Development and Applications of CRISPR-Cas9 for Genome Engineering," *Cell*, 157:1262-1278, (2014).
Hwang, et al., "Efficient Genome Editing in Zebrafish Using a CRISPR-Cas System," *Nature Biotechnology*, 31(3):227-229, (Mar. 2013).
Jiang, et al., "RNA-Guided Editing of Bacterial Genomes Using CRISPR-Cas Systems," *Nature Biotechnology*, 31(3):233-239, (Mar. 2013).
Jinek, et al., "A Programmable Dual-RNA-Guided DNA Endonuclease in Adaptive Bacterial Immunity," *Science*, 337:816-821, (2012).
Jinek, et al., "RNA-Programmed Genome Editing in Human Cells," *eLife Research Article*, pp. 1-9, (2013).
Johnson-Salbia, et al., "Gene Therapy: Optimising DNA Delivery to the Nucleus," *Current Drug Targets*, 2:371-399, (2001).
Jun et al., "CRISPR/Cas: A Novel Way of RNA-Guided Genome Editing," *Hereditas*, 35(11):1265-1273, (2013), English Abstract.
Kariko, et al., "Incorporation of Pseudouridine Into mRNA Yields Superior Nonimmunogenic Vector With Increased Translational Capacity and Biological Stability," *Molecular Therapy*, 16(11):1833-1840, (2008).
Khalili et al., "Genome Editing Strategies: Potential Tools for Eradicating HIV-1/AIDS," *J. Neurovirol*, 21(3):310-321, (2015).
Lagresle-Peyrou, et al., "Human Adenyiate Kinase 2 Deficiency Causes a Profound Haematopoietic Defect Associated With Sensorineural Deafness," *Nat Genet*, 41(1):106-111, (2009).
Late Breaking Abstracts: Presented at the American Society of Gene & Cell Therapy's 16th Annual Meeting, May 15-18, 2013, Salt Lake City, Utah (56 pages).

Li, et al., "MAGeCK Enables Robust Identification of Essential Genes From Genome-Scale CRISPR/Cas9 Knockout Screens," *Genome Biology*, 15:1-12, (2014).
Li, et al., "In vivo Genome Editing Restores Haemostasis in a Mouse Model of Haemophilia," *Nature*, 475:217-221, (2011).
Lin, et al., "Enhanced Homology-Directed Human Genome Engineering by Controlled Timing of CRISPR/Cas9 Delivery," *Elife*, DOI:10.7554:1-13, (2014).
Lin, et al., "CRISPR/Cas9 systems have off-target activity with insertions or Deletions Between Target DNA and Guide RNA Sequences," *Nucleic Acids Research*, pp. 1-13, (2014).
Lloyd, et al., "Beyond the Antigen Receptor: Editing the Genome of T-Cells for Cancer Adoptive Cellular Therapies," *Frontiers in Immunology*, 4(22):1-7, (2013).
Luo, et al., "Synthetic DNA delivery systems," *Nature Biotechnology*, 18:33-37, (2000).
Mali, et al., "RNA-Guided Human Genome Engineering via Cas9," *Science*, 339: 823-826 (2013).
Mandal, et al., "Reprogramming Human Fibroblasts to Pluripotency Using Modified mRNA," *Nature Protocols*, 8(3):568-582, (2013).
Merkle, et al., "Modeling Human Disease with Pluripotent Stem Cells: from Genome Association to Function," *Cell Stem Cell*, 12:656-668, (2013).
Musunuru, "Genetic and Functional Analysis of a Novel Locus Associated with LDL-C and MI," *National Institutes of Health Grant No. 1K99HL098364-01*, (Funding Start Date May 3, 2010), Abstract.
Musunuru, "Stem Cell Models of Familial Combined Hypolipidemia," *National Institutes of Health Grant No. 1R01HL118744-01* (Funding Start Date Feb. 1, 2013), Abstract.
Palu, et al., "In Pursuit of New Developments for Gene Therapy of Human Diseases," *Journal of Biotechnology*, 68:1-13, (1999).
Pelletier, et al., "Mouse Genome Engineering via CRISPR-Cas9 for Study of Immune Function," *Cell Press*, 42:18-27, (2015).
Pfeifer, et al., "Gene Therapy: Promises and Problems," *Annu. Rev. Genomics Hum. Genet.*, 2:177-211, (2001).
Porteus, et al., "Gene Targeting Using Zinc Finger Nucleases," *Nature Biotechnology*, 23(8):967-973, (2005).
Ramalingam, et al., "A CRISPR Way to Engineer the Human Genome," *Genome Biology*, 14(107):1-4, (2013).
Ramirez, et al., "Unexpected Failure Rates for Modular Assembly of Engineered Zinc Fingers," *Nature Methods*, 5(5):374-375, (2008).
Ran, et al., "Double Nicking by RNA-Guided CRISPR Cas9 for Enhanced Genome Editing Specificity," *Cell*, 154:1380-1389, (2013).
Randau, "RNA Processing in the Minimal Organism Nanoarchaeum Equitans," *Genome Biol* 13.7:6, (2012).
Ren, et al., "Multiplex Genome Editing to Generate Universal Car T Cells Resistant to PD1 Inhibition," *Clin. Cancer Res.*, 23(9):2255-2266, (May 1, 2017).
Rieder, et al., *Homo sapiens* Interleukin 2 Receptor, Gamma (Severe Combined Immunodeficiency) (IL2RG) Gene, Complete cds: Genbank: AY692262.1. Jul. 21, 2004 [Retrieved on Mar. 3, 2016]. Retrieved from the Internet: <URL: http://www.ncbi.nlm.nih.gov/nucleotide/50897 469>; pp. 1-4.
Schwank, et al., "Functional Repair of CFTR by CRISPR/Cas9 in Intestinal Stem Cell Organoids of Cystic Fibrosis Patients," *Cell Stem Cell*, 13:653-658, (2013).
Shalem, et al., "Genome-Scale CRISPR-Cas9 Knockout Screening in Human Cells," *Science*, 343:84-87, (2014).
Shen, et al., "Generation of Gene-Modified Mice via Cas9/RNA-Mediated Gene Targeting," *Cell Research*, 23:720-723, (2013).
Shoji, et al., "Current Status of Delivery Systems to Improve Target Efficacy of Oligonucleotides," *Current Pharmaceutical Design*, 10:785-796, (2004).
Smithies, et al., "Insertion of DNA Sequences Into the Human Chromosomal β-Globin Locus by Homologous Recombination," *Nature*, 317(19):230-234, (Sep. 1985).
Talkowski, et al., "Next-Generation Sequencing Strategies Enable Routine Detection of Balanced Chromosome Rearrangements for Clinical Diagnostics and Genetic Research," *The American Journal of Human Genetics*, 88:469-481, (2011).

(56) References Cited

OTHER PUBLICATIONS

Tasher, et al., "The Genetic Basis of Severe Combined Immunodeficiency and its Variants," *The Application of Clinical Genetics*, 5:67-80, (2012).
Tebas, et al., "Gene Editing of CCR5 in Autologous CD4 T Cells of Persons Infected with HIV," *The New England Journal of Medicine*, 370(10):901-910, (Mar. 6, 2014).
Wang, et al., "Genetic Screens in Human Cells Using the CRISPR-Cas9 System," *Science*, 343:80-84, (2014).
Wang, et al., "One-Step Generation of Mice Carrying Mutations in Multiple Genes by CRISPR/Cas-Mediated Genome Engineering," *Cell*, 153:910-918, (2013).
Wiginton, et al., "Complete Sequence and Structure of the Gene for Human Adenosine Deaminase," *Biochemistry*, 25(25): 8234-8244, Abstract, (1986).
Wilen, et al., "Engineering HIV-Resistant Human CD4+ T Cells With CXCR4-Specific Zinc-Finger Nucleases," *PLoS Pathogens*, 7(4):1-15, (Apr. 2011).
Woodbine, et al., "PRKDC Mutations in a SCID Patient with Profound Neurological Abnormalities.," *The Journal of Clinical Investigation*, 123(7):2969-2980, (2013).
Wu, et al., "Target specificity of the CRISPR-Cas9 system," *Quantitative Biology*, 2(2):59-70, (2014).
Xie et al., "Seamless Gene Correction of β-Thalassemia Mutations in Patient-Specific iPSCs Using CRISPR/Cas9 and piggyBac," *Genome Research*, 24:1526-1533, (2014).
Zhang et al., "CRISPR/Cas9 for Genome Editing: Progress, Implications and Challenges," *HMG Advance Acess*, Published Mar. 20, 2014 pp. 1-21.
Extended European Search Report from European Application 14779492.9, dated Nov. 29, 2016.
Extended European Search Report from European Application 14822545.1, dated Oct. 24, 2016.
International Preliminary Report on Patentability for International Application PCT/US2014/46034, mailed Jan. 21, 2016.
International Search Report for International Application PCT/US2015/054762, dated Mar. 11, 2016.
International Search Report for International Application PCT/US2015/054747, dated Apr. 29, 2016.
International Search Report for International Application PCT/US2014/033082, dated Nov. 4, 2014.
Third Party Observation for PCT Application PCT/US2014/033082, made/submitted Aug. 3, 2015.
Third Party Submission Under 37 CFR 1.290 for U.S. Appl. No. 14/485,288, made/submitted Jul. 14, 2015.
Final Office Action for U.S. Appl. No. 14/485,288, dated Apr. 26, 2017.
Final Office Action for U.S. Appl. No. 14/809,787, dated Dec. 2, 2016.
Final Office Action for U.S. Appl. No. 14/485,288, dated Aug. 24, 2015.
Non-Final Office Action for U.S. Appl. No. 14/485,288, dated Sep. 6, 2016).
Non-Final Office Action for U.S. Appl. No. 14/485,288, dated Mar. 26, 2015.
Non-Final Office Action for U.S. Appl. No. 14/509,787, dated Apr. 11, 2016.
Notice of Allowance for U.S. Appl. No. 14/485,288, dated Jul. 14, 2017).
Non-Final Office Action for U.S. Appl. No. 14/509,924, dated Jul. 29, 2016.
Final Office Action for U.S. Appl. No. 14/509,924, dated Feb. 14, 2017.
Gussow, et al., "The Human $\beta_2$-Microglobulin Gene. Primary Structure and Definition of the Transcriptional Unit," *Journal of Immunology*, 139(9):3132-3138 (Nov. 1, 1987).
Mandal, et al., "Efficient Ablation of Genes in Human Hematopoietic Stem and Effector Cells Using CRISPR/Cas9," *Cell Stem Cell*, 15:643-652, (Nov. 6, 2014).
Riolobis, et al., "HLA Engineering of Human Pluripotent Stem Cells," *The American Society of Gene & Cell Therapy*, 21(6):1232-1241, (Jun. 2013).
International Search Report for PCT/US15/59621, dated Jun. 3, 2016.
Han, et al., "Generation of Hypoimmunogenic Human Pluripotent Stem Cells," Proceedings of The National Academy of Sciences, 116(21):10441-10446, (2019).

\* cited by examiner

```
5109       gg cctggaggct atccagcgtg agtctctcct accctcccgc tctggtcctt
5161 cctctcccgc tctgcaccct ctgtggcctt cgctgtgctc tctcgctccg tgacttccct
5221 tctccaagtt ctccttggtg gccgccgtg gggctagtcc agggctggat ctcgggaag
5281 cggcggggtg gctgggagt ggggaaggg gtgcgcaccc gggacgcgcg ctacttgcc
5341 ctttcggcgg ggagcagggg agacctttgg cctacggcga cgggagggtc gggacaaagt
5401 ttagggcgtc gataagcgtc agagcgccga ggttggggga gggtttctct tccgctcttt
5461 cgcggggcct ctggctcccc cagcgcagct ggagtggggg acgggtaggc tcgtcccaaa
5521 ggcgcggcgc tgaggtttgt gaacgcgtgg agggcgctt ggggtctggg ggaggcgtcg
5581 cccggtaag cctgtctgct gcggctctgc ttcccttaga ctggagagct gtggacttcg
5641 tctaggcgcc cgctaagttc gcatgtccta gcacctctgg gtctatgtgg ggccacaccg
5701 tggggaggaa acagcacgcg acgtttgtag aatgcttggc tgtgatacaa agcgtttcg
5761 aataattaac ttatttgttc ccatcacatg tcacttttaa aaattataa gaactcccg
5821 ttattgacat ctttctgtgt gccaaggact ttatgtgctt tgcgtcattt aattttgaaa
5881 acagttatct tccgccatag ataactacta tggttatctt ctgcctctca cagatgaaga
5941 aactaaggca ccgagatttt aagaaactta attacacagg ggataaatgg cagcaatcga
6001 gattgaagtc aagcctaacc agggctttg cgggagcgca tgcctttgg ctgtaattcg
6061 tgcatttttc tttaagaaaa acgcctgcct tctgcgtgag attctccaga gcaaactggg
6121 cggcatgggc cctgtggtct tttcgtacag agggcttcct cttggctct ttgcctggtt
6181 gtttccaaga tgtactgtgc ctcttacttt cggttttgaa aacatgaggg ggttgggcgt
6241 ggtagcttac gcctgtaatc ccagcactta ggaggccga ggcgggagga tggcttgagg
6301 tccgtagttg agaccagcct ggccaacatg gtgaagcctg gtctctacaa aaaataataa
6361 caaaaattag ccgggtgtgg tggctcgtgc ctgtggtccc agctgctcgg gtggctgagg
6421 cggaggatc tcttgagctt aggctttga gctatcatgg cgccagtgca ctccagcgtg
6481 ggcaacagag cgagaccccg tctctcaaaa aagaaaaaaa aaaaaaaga aagagaaaag
6541 aaaagaaaga aagaagtgaa ggtttgtcag tcaggggagc tgtaaaacca ttaataaga
6601 taatccaaga tggttaccaa gactgttgag gacgccagag atcttgagca ctctaagt
6661 acctggcaat acactaagcg cgctcacctt ttcctctggc aaacatgat cgaaagcaga
6721 atgttttgat catgagaaaa ttgcattaa tttgaataca atttattac aacataagg
6781 ataatgtata tatcaccacc attactggta tttgctggtt atgttagaty tcattttaaa
6841 aaataacaat ctgatattca aaaaaaatc ttatttgaa aatttccaaa gtaatacatg
6901 ccatgcatag accattctg gaagatacca caagaaacat gtaatgatga ttgcctctga
6961 aggtctattt tcctcctctg acctgtgtgt gggttttgtt ttgttttac tgtgggcata
7021 aattaatttt tcagttaagt tttggaagct taaataactc tccaaaagtc ataaagccag
7081 taactggttg agcccaaatt caaaccagc ctgtctgata cttgtcctct tcttagaaaa
7141 gattacagtg atgtctcac aaaatcttgc cgccttccct caaacagaga gttccaggca
7201 ggatgaatct gtgctctgat ccctgaggca tttaatatgt tcttattatt agaagctcag
7261 atgcaaagag ctctcttagc ttttaatgtt atgaaaaaaa tcaggtcttc attagattcc
7321 ccaatccacc t (SEQ ID NO: 1)
```

FIG. 1

| Guide ribonucleic acids targeting CCR5 | |
|---|---|
| Guide ID | Sequence |
| crCCR5_A | GCTGCCGCCCAGTGGGACTT (SEQ ID NO: 2) |
| crCCR5_B | GATCTGGTAAAGATGATTCC (SEQ ID NO: 3) |
| crCCR5_C | ACAATGTGTCAACTCTTGAC (SEQ ID NO: 4) |
| crCCR5_D | TCACTATGCTGCCGCCCAGT (SEQ ID NO: 5) |
| crCCR5_O | GGTGACAAGTGTGATCACTT (SEQ ID NO: 6) |
| crCCR5_P | GACAAGTGTGATCACTTGGG (SEQ ID NO: 7) |
| crCCR5_Q | GCTGTGTTTGCGTCTCTCCC (SEQ ID NO: 8) |

FIG. 2

| Guide ribonucleic acids targeting B2M | |
|---|---|
| Guide ID | Sequence |
| crB2M_1 | GATGTCTCGCTCCGTGGCCT (SEQ ID NO: 9) |
| crB2M_2 | CTCGCGCTACTCTCTCTTTC (SEQ ID NO: 10) |
| crB2M_3 | GACTCACGCTGGATAGCCTC (SEQ ID NO: 11) |
| crB2M_4 | CCAGAAAGAGAGAGTAGCGC (SEQ ID NO: 12) |
| crB2M_5 | CACAGCTAAGGCCACGGAGC (SEQ ID NO: 13) |
| crB2M_6 | GGCCGAGATGTCTCGCTCCG (SEQ ID NO: 14) |
| crB2M_7 | TTGCGGGAGCGCATGCCTTT (SEQ ID NO: 15) |
| crB2M_8 | CCACCTCTTGATGGGGCTAG (SEQ ID NO: 16) |
| crB2M_9 | ATACCTTGGGTTGATCCACT (SEQ ID NO: 17) |
| crB2M_10 | CGTGAGTAAACCTGAATCTT (SEQ ID NO: 18) |
| crB2M_11 | AGTCAACTTCAATGTCGGAA (SEQ ID NO: 19) |
| crB2M_12 | CATAGATCGAGACATGTAAG (SEQ ID NO: 20) |
| crB2M_13 | GCTACTCTCTCTTTCTGGCC (SEQ ID NO: 21) |
| crB2M_14 | ACCCAAACCAAGCCTTTCTA (SEQ ID NO: 22) |
| crB2M_15 | TATAAGTGGAGGCGTCGCGC (SEQ ID NO: 23) |

FIG. 3

| | | |
|---|---|---|
| >gRNA0 | cctgcgggccttgtcctgat | SEQ ID NO: 881 |
| >gRNA1 | cgggccttgtcctgattggc | SEQ ID NO: 882 |
| >gRNA2 | gggccttgtcctgattggct | SEQ ID NO: 883 |
| >gRNA3 | gctgggcacgcgtttaatat | SEQ ID NO: 884 |
| >gRNA4 | gggcacgcgtttaatataag | SEQ ID NO: 885 |
| >gRNA5 | gcacgcgtttaatataagtg | SEQ ID NO: 886 |
| >gRNA6 | cacgcgtttaatataagtgg | SEQ ID NO: 887 |
| >gRNA7 | tataagtggaggcgtcgcgc | SEQ ID NO: 888 |
| >gRNA8 | aagtggaggcgtcgcgctgg | SEQ ID NO: 889 |
| >gRNA9 | agtggaggcgtcgcgctggc | SEQ ID NO: 890 |
| >gRNA10 | cgcgctggcgggcattcctg | SEQ ID NO: 891 |
| >gRNA11 | gcgggcattcctgaagctga | SEQ ID NO: 892 |
| >gRNA12 | ttcctgaagctgacagcatt | SEQ ID NO: 893 |
| >gRNA13 | tcctgaagctgacagcattc | SEQ ID NO: 894 |
| >gRNA14 | aagctgacagcattcgggcc | SEQ ID NO: 895 |
| >gRNA15 | ggccgagatgtctcgctccg | SEQ ID NO: 896 |
| >gRNA16 | gatgtctcgctccgtggcct | SEQ ID NO: 897 |
| >gRNA17 | ctcgcgctactctctctttc | SEQ ID NO: 898 |
| >gRNA18 | gctactctctctttctggcc | SEQ ID NO: 899 |
| >gRNA19 | tactctctctttctggcctg | SEQ ID NO: 900 |
| >gRNA20 | actctctctttctggcctgg | SEQ ID NO: 901 |
| >gRNA21 | tttctggcctggaggctatc | SEQ ID NO: 902 |
| >gRNA22 | gcctggaggctatccagcgt | SEQ ID NO: 903 |
| >gRNA23 | tctctcctaccctcccgctc | SEQ ID NO: 904 |
| >gRNA24 | ctcccgctctgcaccctctg | SEQ ID NO: 905 |
| >gRNA25 | ctccgtgacttcccttctcc | SEQ ID NO: 906 |
| >gRNA26 | tcccttctccaagttctcct | SEQ ID NO: 907 |
| >gRNA27 | ctttctccaagttctccttgg | SEQ ID NO: 908 |
| >gRNA28 | ttctccttggtggcccgccg | SEQ ID NO: 909 |
| >gRNA29 | tctccttggtggcccgccgt | SEQ ID NO: 910 |
| >gRNA30 | ctccttggtggcccgccgtg | SEQ ID NO: 911 |
| >gRNA31 | ttggtggcccgccgtggggc | SEQ ID NO: 912 |
| >gRNA32 | ggcccgccgtggggctagtc | SEQ ID NO: 913 |
| >gRNA33 | gcccgccgtggggctagtcc | SEQ ID NO: 914 |
| >gRNA34 | cccgccgtggggctagtcca | SEQ ID NO: 915 |
| >gRNA35 | ccgtggggctagtccagggc | SEQ ID NO: 916 |
| >gRNA36 | gctagtccagggctggatct | SEQ ID NO: 917 |
| >gRNA37 | ctagtccagggctggatctc | SEQ ID NO: 918 |
| >gRNA38 | tagtccagggctggatctcg | SEQ ID NO: 919 |
| >gRNA39 | tccagggctggatctcggg | SEQ ID NO: 920 |
| >gRNA40 | agggctggatctcggggaag | SEQ ID NO: 921 |

FIG. 3 cont.

| | | |
|---|---|---|
| >gRNA41 | gctggatctcggggaagcgg | SEQ ID NO: 922 |
| >gRNA42 | ctggatctcggggaagcggc | SEQ ID NO: 923 |
| >gRNA43 | tggatctcggggaagcggcg | SEQ ID NO: 924 |
| >gRNA44 | atctcggggaagcggcgggg | SEQ ID NO: 925 |
| >gRNA45 | ggggaagcggcggggtggcc | SEQ ID NO: 926 |
| >gRNA46 | gggaagcggcggggtggcct | SEQ ID NO: 927 |
| >gRNA47 | gaagcggcggggtggcctgg | SEQ ID NO: 928 |
| >gRNA48 | gcggcggggtggcctgggag | SEQ ID NO: 929 |
| >gRNA49 | cggcggggtggcctgggagt | SEQ ID NO: 930 |
| >gRNA50 | ggcggggtggcctgggagtg | SEQ ID NO: 931 |
| >gRNA51 | ggggtggcctgggagtgggg | SEQ ID NO: 932 |
| >gRNA52 | gggtggcctgggagtgggga | SEQ ID NO: 933 |
| >gRNA53 | ggtggcctgggagtggggaa | SEQ ID NO: 934 |
| >gRNA54 | gtggcctgggagtggggaag | SEQ ID NO: 935 |
| >gRNA55 | tggcctgggagtggggaagg | SEQ ID NO: 936 |
| >gRNA56 | tggggaaggggtgcgcacc | SEQ ID NO: 937 |
| >gRNA57 | ggggaaggggtgcgcaccc | SEQ ID NO: 938 |
| >gRNA58 | cgcgcgctacttgccccttt | SEQ ID NO: 939 |
| >gRNA59 | gcgctacttgccccttttcgg | SEQ ID NO: 940 |
| >gRNA60 | cgctacttgccccttttcgc | SEQ ID NO: 941 |
| >gRNA61 | gctacttgccccttttcggcg | SEQ ID NO: 942 |
| >gRNA62 | tacttgccccttttcggcggg | SEQ ID NO: 943 |
| >gRNA63 | ttgccccttttcggcggggag | SEQ ID NO: 944 |
| >gRNA64 | tgccccttttcggcggggagc | SEQ ID NO: 945 |
| >gRNA65 | gccccttttcggcggggagca | SEQ ID NO: 946 |
| >gRNA66 | ccccttttcggcggggagcag | SEQ ID NO: 947 |
| >gRNA67 | cctttcggcggggagcaggg | SEQ ID NO: 948 |
| >gRNA68 | cggggagcaggggagacctt | SEQ ID NO: 949 |
| >gRNA69 | caggggagacctttggccta | SEQ ID NO: 950 |
| >gRNA70 | agacctttggcctacggcga | SEQ ID NO: 951 |
| >gRNA71 | gacctttggcctacggcgac | SEQ ID NO: 952 |
| >gRNA72 | cctttggcctacggcgacgg | SEQ ID NO: 953 |
| >gRNA73 | ctttggcctacggcgacggg | SEQ ID NO: 954 |
| >gRNA74 | tttggcctacggcgacggga | SEQ ID NO: 955 |
| >gRNA75 | gcctacggcgacgggagggt | SEQ ID NO: 956 |
| >gRNA76 | cctacggcgacgggagggtc | SEQ ID NO: 957 |
| >gRNA77 | gcgacgggagggtcgggaca | SEQ ID NO: 958 |
| >gRNA78 | gggagggtcgggacaaagtt | SEQ ID NO: 959 |
| >gRNA79 | ggagggtcgggacaaagttt | SEQ ID NO: 960 |
| >gRNA80 | gagggtcgggacaaagttta | SEQ ID NO: 961 |
| >gRNA81 | acaaagtttagggcgtcgat | SEQ ID NO: 962 |

FIG. 3 cont.

| >gRNA82 | tttagggcgtcgataagcgt | SEQ ID NO: 963 |
|---|---|---|
| >gRNA83 | tagggcgtcgataagcgtca | SEQ ID NO: 964 |
| >gRNA84 | tcgataagcgtcagagcgcc | SEQ ID NO: 965 |
| >gRNA85 | cgataagcgtcagagcgccg | SEQ ID NO: 966 |
| >gRNA86 | aagcgtcagagcgccgaggt | SEQ ID NO: 967 |
| >gRNA87 | agcgtcagagcgccgaggtt | SEQ ID NO: 968 |
| >gRNA88 | gcgtcagagcgccgaggttg | SEQ ID NO: 969 |
| >gRNA89 | cgtcagagcgccgaggttgg | SEQ ID NO: 970 |
| >gRNA90 | tcagagcgccgaggttgggg | SEQ ID NO: 971 |
| >gRNA91 | cagagcgccgaggttggggg | SEQ ID NO: 972 |
| >gRNA92 | agagcgccgaggttggggga | SEQ ID NO: 973 |
| >gRNA93 | gtttctcttccgctctttcg | SEQ ID NO: 974 |
| >gRNA94 | tttctcttccgctctttcgc | SEQ ID NO: 975 |
| >gRNA95 | ttctcttccgctctttcgcg | SEQ ID NO: 976 |
| >gRNA96 | ccgctctttcgcggggcctc | SEQ ID NO: 977 |
| >gRNA97 | cgcggggcctctggctcccc | SEQ ID NO: 978 |
| >gRNA98 | ggcctctggctcccccagcg | SEQ ID NO: 979 |
| >gRNA99 | tctggctcccccagcgcagc | SEQ ID NO: 980 |
| >gRNA100 | tggctcccccagcgcagctg | SEQ ID NO: 981 |
| >gRNA101 | ctcccccagcgcagctggag | SEQ ID NO: 982 |
| >gRNA102 | tcccccagcgcagctggagt | SEQ ID NO: 983 |
| >gRNA103 | ccccagcgcagctggagtg | SEQ ID NO: 984 |
| >gRNA104 | ccccagcgcagctggagtgg | SEQ ID NO: 985 |
| >gRNA105 | agcgcagctggagtggggga | SEQ ID NO: 986 |
| >gRNA106 | gcgcagctggagtgggggac | SEQ ID NO: 987 |
| >gRNA107 | cagctggagtgggggacggg | SEQ ID NO: 988 |
| >gRNA108 | agctggagtgggggacgggt | SEQ ID NO: 989 |
| >gRNA109 | ggacgggtaggctcgtccca | SEQ ID NO: 990 |
| >gRNA110 | gacgggtaggctcgtcccaa | SEQ ID NO: 991 |
| >gRNA111 | gtaggctcgtcccaaaggcg | SEQ ID NO: 992 |
| >gRNA112 | cgtcccaaaggcgcggcgct | SEQ ID NO: 993 |
| >gRNA113 | gtcccaaaggcgcggcgctg | SEQ ID NO: 994 |
| >gRNA114 | cgctgaggtttgtgaacgcg | SEQ ID NO: 995 |
| >gRNA115 | ctgaggtttgtgaacgcgtg | SEQ ID NO: 996 |
| >gRNA116 | tgaggtttgtgaacgcgtgg | SEQ ID NO: 997 |
| >gRNA117 | gaggtttgtgaacgcgtgga | SEQ ID NO: 998 |
| >gRNA118 | aggtttgtgaacgcgtggag | SEQ ID NO: 999 |
| >gRNA119 | tgaacgcgtggaggggcgct | SEQ ID NO: 1000 |
| >gRNA120 | gaacgcgtggaggggcgctt | SEQ ID NO: 1001 |
| >gRNA121 | aacgcgtggaggggcgcttg | SEQ ID NO: 1002 |
| >gRNA122 | gtggaggggcgcttgggggtc | SEQ ID NO: 1003 |

FIG. 3 cont.

| | | |
|---|---|---|
| >gRNA123 | tggaggggcgcttggggtct | SEQ ID NO: 1004 |
| >gRNA124 | ggaggggcgcttggggtctg | SEQ ID NO: 1005 |
| >gRNA125 | gaggggcgcttggggtctgg | SEQ ID NO: 1006 |
| >gRNA126 | ggggcgcttggggtctgggg | SEQ ID NO: 1007 |
| >gRNA127 | gggcgcttggggtctggggg | SEQ ID NO: 1008 |
| >gRNA128 | ggtctgggggaggcgtcgcc | SEQ ID NO: 1009 |
| >gRNA129 | gtctgggggaggcgtcgccc | SEQ ID NO: 1010 |
| >gRNA130 | gggggaggcgtcgcccgggt | SEQ ID NO: 1011 |
| >gRNA131 | ccgggtaagcctgtctgctg | SEQ ID NO: 1012 |
| >gRNA132 | tgctgcggctctgcttccct | SEQ ID NO: 1013 |
| >gRNA133 | cggctctgcttcccttagac | SEQ ID NO: 1014 |
| >gRNA134 | gctctgcttcccttagactg | SEQ ID NO: 1015 |
| >gRNA135 | tctgcttcccttagactgga | SEQ ID NO: 1016 |
| >gRNA136 | tcccttagactggagagctg | SEQ ID NO: 1017 |
| >gRNA137 | ggagagctgtggacttcgtc | SEQ ID NO: 1018 |
| >gRNA138 | gagagctgtggacttcgtct | SEQ ID NO: 1019 |
| >gRNA139 | acttcgtctaggcgcccgct | SEQ ID NO: 1020 |
| >gRNA140 | cccgctaagttcgcatgtcc | SEQ ID NO: 1021 |
| >gRNA141 | ttcgcatgtcctagcacctc | SEQ ID NO: 1022 |
| >gRNA142 | tcgcatgtcctagcacctct | SEQ ID NO: 1023 |
| >gRNA143 | ctagcacctctgggtctatg | SEQ ID NO: 1024 |
| >gRNA144 | tagcacctctgggtctatgt | SEQ ID NO: 1025 |
| >gRNA145 | agcacctctgggtctatgtg | SEQ ID NO: 1026 |
| >gRNA146 | gtctatgtggggccacaccg | SEQ ID NO: 1027 |
| >gRNA147 | tctatgtggggccacaccgt | SEQ ID NO: 1028 |
| >gRNA148 | ctatgtggggccacaccgtg | SEQ ID NO: 1029 |
| >gRNA149 | atgtggggccacaccgtggg | SEQ ID NO: 1030 |
| >gRNA150 | tgtggggccacaccgtgggg | SEQ ID NO: 1031 |
| >gRNA151 | gccacaccgtggggaggaaa | SEQ ID NO: 1032 |
| >gRNA152 | gaaacagcacgcgacgtttg | SEQ ID NO: 1033 |
| >gRNA153 | cgcgacgtttgtagaatgct | SEQ ID NO: 1034 |
| >gRNA154 | gaatgcttggctgtgataca | SEQ ID NO: 1035 |
| >gRNA155 | tgcttggctgtgatacaaag | SEQ ID NO: 1036 |
| >gRNA156 | tgtcacttttaaaaaattat | SEQ ID NO: 1037 |
| >gRNA157 | ttgacatctttctgtgtgcc | SEQ ID NO: 1038 |
| >gRNA158 | tgacatctttctgtgtgcca | SEQ ID NO: 1039 |
| >gRNA159 | gcgtcatttaattttgaaaa | SEQ ID NO: 1040 |
| >gRNA160 | aaaacagttatcttccgcca | SEQ ID NO: 1041 |
| >gRNA161 | tccgccatagataactacta | SEQ ID NO: 1042 |
| >gRNA162 | tggttatcttctgcctctca | SEQ ID NO: 1043 |
| >gRNA163 | tcttctgcctctcacagatg | SEQ ID NO: 1044 |

FIG. 3 cont.

| | | |
|---|---|---|
| >gRNA164 | ctctcacagatgaagaaact | SEQ ID NO: 1045 |
| >gRNA165 | tctcacagatgaagaaacta | SEQ ID NO: 1046 |
| >gRNA166 | gatgaagaaactaaggcacc | SEQ ID NO: 1047 |
| >gRNA167 | aactaaggcaccgagatttt | SEQ ID NO: 1048 |
| >gRNA168 | ttttaagaaacttaattaca | SEQ ID NO: 1049 |
| >gRNA169 | tttaagaaacttaattacac | SEQ ID NO: 1050 |
| >gRNA170 | ttaagaaacttaattacaca | SEQ ID NO: 1051 |
| >gRNA171 | taagaaacttaattacacag | SEQ ID NO: 1052 |
| >gRNA172 | ttaattacacaggggataaa | SEQ ID NO: 1053 |
| >gRNA173 | attacacaggggataaatgg | SEQ ID NO: 1054 |
| >gRNA174 | ggggataaatggcagcaatc | SEQ ID NO: 1055 |
| >gRNA175 | aatggcagcaatcgagattg | SEQ ID NO: 1056 |
| >gRNA176 | cagcaatcgagattgaagtc | SEQ ID NO: 1057 |
| >gRNA177 | agattgaagtcaagcctaac | SEQ ID NO: 1058 |
| >gRNA178 | gattgaagtcaagcctaacc | SEQ ID NO: 1059 |
| >gRNA179 | attgaagtcaagcctaacca | SEQ ID NO: 1060 |
| >gRNA180 | aagcctaaccagggcttttg | SEQ ID NO: 1061 |
| >gRNA181 | agcctaaccagggcttttgc | SEQ ID NO: 1062 |
| >gRNA182 | cctaaccagggcttttgcgg | SEQ ID NO: 1063 |
| >gRNA183 | ttgcgggagcgcatgccttt | SEQ ID NO: 1064 |
| >gRNA184 | taattcgtgcattttttttt | SEQ ID NO: 1065 |
| >gRNA185 | aaaacgcctgccttctgcgt | SEQ ID NO: 1066 |
| >gRNA186 | gccttctgcgtgagattctc | SEQ ID NO: 1067 |
| >gRNA187 | cttctgcgtgagattctcca | SEQ ID NO: 1068 |
| >gRNA188 | tgagattctccagagcaaac | SEQ ID NO: 1069 |
| >gRNA189 | gagattctccagagcaaact | SEQ ID NO: 1070 |
| >gRNA190 | attctccagagcaaactggg | SEQ ID NO: 1071 |
| >gRNA191 | ccagagcaaactgggcggca | SEQ ID NO: 1072 |
| >gRNA192 | cagagcaaactgggcggcat | SEQ ID NO: 1073 |
| >gRNA193 | actgggcggcatgggccctg | SEQ ID NO: 1074 |
| >gRNA194 | ggccctgtggtcttttcgta | SEQ ID NO: 1075 |
| >gRNA195 | ccctgtggtcttttcgtaca | SEQ ID NO: 1076 |
| >gRNA196 | cctgtggtcttttcgtacag | SEQ ID NO: 1077 |
| >gRNA197 | ctgtggtcttttcgtacaga | SEQ ID NO: 1078 |
| >gRNA198 | cgtacagagggcttcctctt | SEQ ID NO: 1079 |
| >gRNA199 | ttcctctttggctctttgcc | SEQ ID NO: 1080 |
| >gRNA200 | ctctttgcctggttgtttcc | SEQ ID NO: 1081 |
| >gRNA201 | tgtactgtgcctcttacttt | SEQ ID NO: 1082 |
| >gRNA202 | actttcggttttgaaaacat | SEQ ID NO: 1083 |
| >gRNA203 | ctttcggttttgaaaacatg | SEQ ID NO: 1084 |
| >gRNA204 | tttcggttttgaaaacatga | SEQ ID NO: 1085 |

FIG. 3 cont.

| | | |
|---|---|---|
| >gRNA205 | ttcggttttgaaaacatgag | SEQ ID NO: 1086 |
| >gRNA206 | tcggttttgaaaacatgagg | SEQ ID NO: 1087 |
| >gRNA207 | ttttgaaaacatgagggggt | SEQ ID NO: 1088 |
| >gRNA208 | tttgaaaacatgagggggtt | SEQ ID NO: 1089 |
| >gRNA209 | aaacatgagggggttgggcg | SEQ ID NO: 1090 |
| >gRNA210 | catgagggggttgggcgtgg | SEQ ID NO: 1091 |
| >gRNA211 | gtagcttacgcctgtaatcc | SEQ ID NO: 1092 |
| >gRNA212 | acgcctgtaatcccagcact | SEQ ID NO: 1093 |
| >gRNA213 | cgcctgtaatcccagcactt | SEQ ID NO: 1094 |
| >gRNA214 | gcctgtaatcccagcactta | SEQ ID NO: 1095 |
| >gRNA215 | ctgtaatcccagcacttagg | SEQ ID NO: 1096 |
| >gRNA216 | tgtaatcccagcacttaggg | SEQ ID NO: 1097 |
| >gRNA217 | tcccagcacttagggaggcc | SEQ ID NO: 1098 |
| >gRNA218 | cccagcacttagggaggccg | SEQ ID NO: 1099 |
| >gRNA219 | agcacttagggaggccgagg | SEQ ID NO: 1100 |
| >gRNA220 | gcacttagggaggccgaggc | SEQ ID NO: 1101 |
| >gRNA221 | acttagggaggccgaggcgg | SEQ ID NO: 1102 |
| >gRNA222 | cttagggaggccgaggcggg | SEQ ID NO: 1103 |
| >gRNA223 | gggaggccgaggcgggagga | SEQ ID NO: 1104 |
| >gRNA224 | ccgaggcgggaggatggctt | SEQ ID NO: 1105 |
| >gRNA225 | cgaggcgggaggatggcttg | SEQ ID NO: 1106 |
| >gRNA226 | ggaggatggcttgaggtccg | SEQ ID NO: 1107 |
| >gRNA227 | atggcttgaggtccgtagtt | SEQ ID NO: 1108 |
| >gRNA228 | ttgaggtccgtagttgagac | SEQ ID NO: 1109 |
| >gRNA229 | gtccgtagttgagaccagcc | SEQ ID NO: 1110 |
| >gRNA230 | tgagaccagcctggccaaca | SEQ ID NO: 1111 |
| >gRNA231 | ccagcctggccaacatggtg | SEQ ID NO: 1112 |
| >gRNA232 | ctggccaacatggtgaagcc | SEQ ID NO: 1113 |
| >gRNA233 | caaaaaataataacaaaaat | SEQ ID NO: 1114 |
| >gRNA234 | aaataataacaaaaattagc | SEQ ID NO: 1115 |
| >gRNA235 | aataataacaaaaattagcc | SEQ ID NO: 1116 |
| >gRNA236 | taacaaaaattagccgggtg | SEQ ID NO: 1117 |
| >gRNA237 | caaaaattagccgggtgtgg | SEQ ID NO: 1118 |
| >gRNA238 | ggtgtggtggctcgtgcctg | SEQ ID NO: 1119 |
| >gRNA239 | gtggctcgtgcctgtggtcc | SEQ ID NO: 1120 |
| >gRNA240 | gcctgtggtcccagctgctc | SEQ ID NO: 1121 |
| >gRNA241 | tgtggtcccagctgctccgg | SEQ ID NO: 1122 |
| >gRNA242 | tcccagctgctccggtggct | SEQ ID NO: 1123 |
| >gRNA243 | cccagctgctccggtggctg | SEQ ID NO: 1124 |
| >gRNA244 | agctgctccggtggctgagg | SEQ ID NO: 1125 |
| >gRNA245 | gctgctccggtggctgaggc | SEQ ID NO: 1126 |

FIG. 3 cont.

| | | |
|---|---|---|
| >gRNA246 | tgctccggtggctgaggcgg | SEQ ID NO: 1127 |
| >gRNA247 | gctccggtggctgaggcggg | SEQ ID NO: 1128 |
| >gRNA248 | ctgaggcgggaggatctctt | SEQ ID NO: 1129 |
| >gRNA249 | gcgggaggatctcttgagct | SEQ ID NO: 1130 |
| >gRNA250 | cgggaggatctcttgagctt | SEQ ID NO: 1131 |
| >gRNA251 | tctcttgagcttaggctttt | SEQ ID NO: 1132 |
| >gRNA252 | cttaggcttttgagctatca | SEQ ID NO: 1133 |
| >gRNA253 | cttttgagctatcatggcgc | SEQ ID NO: 1134 |
| >gRNA254 | atcatggcgccagtgcactc | SEQ ID NO: 1135 |
| >gRNA255 | ggcgccagtgcactccagcg | SEQ ID NO: 1136 |
| >gRNA256 | gcgccagtgcactccagcgt | SEQ ID NO: 1137 |
| >gRNA257 | gtgcactccagcgtgggcaa | SEQ ID NO: 1138 |
| >gRNA258 | gcactccagcgtgggcaaca | SEQ ID NO: 1139 |
| >gRNA259 | tccagcgtgggcaacagagc | SEQ ID NO: 1140 |
| >gRNA260 | cgagaccctgtctctcaaaa | SEQ ID NO: 1141 |
| >gRNA261 | aaaaaagaaaaaaaaaaaaa | SEQ ID NO: 1142 |
| >gRNA262 | aagaaaaaaaaaaaaaaaga | SEQ ID NO: 1143 |
| >gRNA263 | gaaaaaaaaaaaaaagaaa | SEQ ID NO: 1144 |
| >gRNA264 | aaaaaaaaaagaaagagaa | SEQ ID NO: 1145 |
| >gRNA265 | aaaaaagaaagagaaaagaa | SEQ ID NO: 1146 |
| >gRNA266 | aagaaagagaaaagaaaaga | SEQ ID NO: 1147 |
| >gRNA267 | aagagaaaagaaaagaaaga | SEQ ID NO: 1148 |
| >gRNA268 | agaaaagaaaagaaagaaag | SEQ ID NO: 1149 |
| >gRNA269 | agaaagaaagaaagaaagtg | SEQ ID NO: 1150 |
| >gRNA270 | gaaaagaaagaaagaagtga | SEQ ID NO: 1151 |
| >gRNA271 | agaaagaagtgaaggtttgt | SEQ ID NO: 1152 |
| >gRNA272 | agaagtgaaggtttgtcagt | SEQ ID NO: 1153 |
| >gRNA273 | gaagtgaaggtttgtcagtc | SEQ ID NO: 1154 |
| >gRNA274 | aagtgaaggtttgtcagtca | SEQ ID NO: 1155 |
| >gRNA275 | agtgaaggtttgtcagtcag | SEQ ID NO: 1156 |
| >gRNA276 | tgaaggtttgtcagtcaggg | SEQ ID NO: 1157 |
| >gRNA277 | gagctgtaaaaccattaata | SEQ ID NO: 1158 |
| >gRNA278 | accattaataaagataatcc | SEQ ID NO: 1159 |
| >gRNA279 | ttaataaagataatccaaga | SEQ ID NO: 1160 |
| >gRNA280 | gataatccaagatggttacc | SEQ ID NO: 1161 |
| >gRNA281 | agatggttaccaagactgtt | SEQ ID NO: 1162 |
| >gRNA282 | gatggttaccaagactgttg | SEQ ID NO: 1163 |
| >gRNA283 | accaagactgttgaggacgc | SEQ ID NO: 1164 |
| >gRNA284 | caagactgttgaggacgcca | SEQ ID NO: 1165 |
| >gRNA285 | ttgaggacgccagagatctt | SEQ ID NO: 1166 |
| >gRNA286 | agagatcttgagcactttct | SEQ ID NO: 1167 |

FIG. 3 cont.

| | | |
|---|---|---|
| >gRNA287 | ttgagcactttctaagtacc | SEQ ID NO: 1168 |
| >gRNA288 | taagtacctggcaatacact | SEQ ID NO: 1169 |
| >gRNA289 | agcgcgctcaccttttcctc | SEQ ID NO: 1170 |
| >gRNA290 | ctctggcaaaacatgatcga | SEQ ID NO: 1171 |
| >gRNA291 | tggcaaaacatgatcgaaag | SEQ ID NO: 1172 |
| >gRNA292 | aagcagaatgttttgatcat | SEQ ID NO: 1173 |
| >gRNA293 | tacaatttatttacaacata | SEQ ID NO: 1174 |
| >gRNA294 | acaatttatttacaacataa | SEQ ID NO: 1175 |
| >gRNA295 | gtatatatcaccaccattac | SEQ ID NO: 1176 |
| >gRNA296 | ccaccattactggtatttgc | SEQ ID NO: 1177 |
| >gRNA297 | ctggtatttgctggttatgt | SEQ ID NO: 1178 |
| >gRNA298 | tcttattttgaaaatttcca | SEQ ID NO: 1179 |
| >gRNA299 | aaagtaatacatgccatgca | SEQ ID NO: 1180 |
| >gRNA300 | tgccatgcatagaccatttc | SEQ ID NO: 1181 |
| >gRNA301 | catgcatagaccatttctgg | SEQ ID NO: 1182 |
| >gRNA302 | ccatttctggaagataccac | SEQ ID NO: 1183 |
| >gRNA303 | tgtaatgatgattgcctctg | SEQ ID NO: 1184 |
| >gRNA304 | gtaatgatgattgcctctga | SEQ ID NO: 1185 |
| >gRNA305 | ttcctcctctgacctgtgtg | SEQ ID NO: 1186 |
| >gRNA306 | tcctcctctgacctgtgtgt | SEQ ID NO: 1187 |
| >gRNA307 | gttttgttttgttttactg | SEQ ID NO: 1188 |
| >gRNA308 | ttttgttttgttttactgt | SEQ ID NO: 1189 |
| >gRNA309 | gtgggcataaattaatttt | SEQ ID NO: 1190 |
| >gRNA310 | cataaattaattttcagtt | SEQ ID NO: 1191 |
| >gRNA311 | ttaattttcagttaagttt | SEQ ID NO: 1192 |
| >gRNA312 | attttcagttaagttttgg | SEQ ID NO: 1193 |
| >gRNA313 | aagcttaaataactctccaa | SEQ ID NO: 1194 |
| >gRNA314 | ataactctccaaaagtcata | SEQ ID NO: 1195 |
| >gRNA315 | ctctccaaaagtcataaagc | SEQ ID NO: 1196 |
| >gRNA316 | aaagtcataaagccagtaac | SEQ ID NO: 1197 |
| >gRNA317 | cataaagccagtaactggtt | SEQ ID NO: 1198 |
| >gRNA318 | gttgagcccaaattcaaacc | SEQ ID NO: 1199 |
| >gRNA319 | tctgatacttgtcctcttct | SEQ ID NO: 1200 |
| >gRNA320 | tacttgtcctcttcttagaa | SEQ ID NO: 1201 |
| >gRNA321 | cctcttcttagaaaagatta | SEQ ID NO: 1202 |
| >gRNA322 | tcttgccgccttccctcaaa | SEQ ID NO: 1203 |
| >gRNA323 | ttgccgccttccctcaaaca | SEQ ID NO: 1204 |
| >gRNA324 | gccgccttccctcaaacaga | SEQ ID NO: 1205 |
| >gRNA325 | ttccctcaaacagagagttc | SEQ ID NO: 1206 |
| >gRNA326 | tccctcaaacagagagttcc | SEQ ID NO: 1207 |
| >gRNA327 | ctcaaacagagagttccagg | SEQ ID NO: 1208 |

FIG. 3 cont.

| | | |
|---|---|---|
| >gRNA328 | tcaaacagagagttccaggc | SEQ ID NO: 1209 |
| >gRNA329 | gaatctgtgctctgatccct | SEQ ID NO: 1210 |
| >gRNA330 | aatctgtgctctgatccctg | SEQ ID NO: 1211 |
| >gRNA331 | atttaatatgttcttattat | SEQ ID NO: 1212 |
| >gRNA332 | taatatgttcttattattag | SEQ ID NO: 1213 |
| >gRNA333 | tgttcttattattagaagct | SEQ ID NO: 1214 |
| >gRNA334 | ttattagaagctcagatgca | SEQ ID NO: 1215 |
| >gRNA335 | attagaagctcagatgcaaa | SEQ ID NO: 1216 |
| >gRNA336 | tcagatgcaaagagctctct | SEQ ID NO: 1217 |
| >gRNA337 | tttaatgttatgaaaaaaat | SEQ ID NO: 1218 |
| >gRNA338 | ttaatgttatgaaaaaaatc | SEQ ID NO: 1219 |
| >gRNA339 | gaaaaaaatcaggtcttcat | SEQ ID NO: 1220 |
| >gRNA340 | ttccccaatccacctcttga | SEQ ID NO: 1221 |
| >gRNA341 | tccccaatccacctcttgat | SEQ ID NO: 1222 |
| >gRNA342 | ccccaatccacctcttgatg | SEQ ID NO: 1223 |
| >gRNA343 | aatccacctcttgatggggc | SEQ ID NO: 1224 |
| >gRNA344 | ccacctcttgatggggctag | SEQ ID NO: 1225 |
| >gRNA345 | tagtagcctttccttaatga | SEQ ID NO: 1226 |
| >gRNA346 | agtagcctttccttaatgat | SEQ ID NO: 1227 |
| >gRNA347 | gtagcctttccttaatgata | SEQ ID NO: 1228 |
| >gRNA348 | ccttaatgatagggtgtttc | SEQ ID NO: 1229 |
| >gRNA349 | ttaatgatagggtgtttcta | SEQ ID NO: 1230 |
| >gRNA350 | aatgatagggtgtttctaga | SEQ ID NO: 1231 |
| >gRNA351 | tgtttctagagagatatatc | SEQ ID NO: 1232 |
| >gRNA352 | ctagagagatatatctggtc | SEQ ID NO: 1233 |
| >gRNA353 | tagagagatatatctggtca | SEQ ID NO: 1234 |
| >gRNA354 | agagatatatctggtcaagg | SEQ ID NO: 1235 |
| >gRNA355 | tatatctggtcaaggtggcc | SEQ ID NO: 1236 |
| >gRNA356 | ggtactcctccttctcccca | SEQ ID NO: 1237 |
| >gRNA357 | tccttctcccacagcctcc | SEQ ID NO: 1238 |
| >gRNA358 | ctccccacagcctcccagac | SEQ ID NO: 1239 |
| >gRNA359 | tccccacagcctcccagaca | SEQ ID NO: 1240 |
| >gRNA360 | cccacagcctcccagacaag | SEQ ID NO: 1241 |
| >gRNA361 | ccacagcctcccagacaagg | SEQ ID NO: 1242 |
| >gRNA362 | acagcctcccagacaaggag | SEQ ID NO: 1243 |
| >gRNA363 | gcctcccagacaaggaggag | SEQ ID NO: 1244 |
| >gRNA364 | aaggaggagtagctgccttt | SEQ ID NO: 1245 |
| >gRNA365 | tgatcatgtaccctgaatat | SEQ ID NO: 1246 |
| >gRNA366 | ctgaatataagtgtatttaa | SEQ ID NO: 1247 |
| >gRNA367 | gaattttatacacatatatt | SEQ ID NO: 1248 |
| >gRNA368 | ttagtgtcaatctgtatatt | SEQ ID NO: 1249 |

FIG. 3 cont.

| | | |
|---|---|---|
| >gRNA369 | gtgtcaatctgtatatttag | SEQ ID NO: 1250 |
| >gRNA370 | ttcattttcaatgaaaaata | SEQ ID NO: 1251 |
| >gRNA371 | cattttcaatgaaaaatata | SEQ ID NO: 1252 |
| >gRNA372 | attttcttcccacttcccca | SEQ ID NO: 1253 |
| >gRNA373 | tcttcccacttccccatgga | SEQ ID NO: 1254 |
| >gRNA374 | ccacttccccatggatggtc | SEQ ID NO: 1255 |
| >gRNA375 | tctagtcatgcctctcattt | SEQ ID NO: 1256 |
| >gRNA376 | gtcatgcctctcattttgga | SEQ ID NO: 1257 |
| >gRNA377 | aagtactgtttctgaaacat | SEQ ID NO: 1258 |
| >gRNA378 | agtactgtttctgaaacatt | SEQ ID NO: 1259 |
| >gRNA379 | taggcaatatattcccaacc | SEQ ID NO: 1260 |
| >gRNA380 | caatatattcccaacctggc | SEQ ID NO: 1261 |
| >gRNA381 | ttcccaacctggctagttta | SEQ ID NO: 1262 |
| >gRNA382 | tagtttacagcaatcacctg | SEQ ID NO: 1263 |
| >gRNA383 | attactccatttgatcataa | SEQ ID NO: 1264 |
| >gRNA384 | ctccatttgatcataatgga | SEQ ID NO: 1265 |
| >gRNA385 | atgttctgtcccatttgcca | SEQ ID NO: 1266 |
| >gRNA386 | ctatccctgttgtattttat | SEQ ID NO: 1267 |
| >gRNA387 | tatccctgttgtattttatc | SEQ ID NO: 1268 |
| >gRNA388 | cgggtccaactcaaccattt | SEQ ID NO: 1269 |
| >gRNA389 | gggtccaactcaaccattta | SEQ ID NO: 1270 |
| >gRNA390 | caaccatttaaggtatttgc | SEQ ID NO: 1271 |
| >gRNA391 | tgccagctcttgtatgcatt | SEQ ID NO: 1272 |
| >gRNA392 | gccagctcttgtatgcattt | SEQ ID NO: 1273 |
| >gRNA393 | ggttttgtttctttgttttt | SEQ ID NO: 1274 |
| >gRNA394 | tgttttttagctcatgaaat | SEQ ID NO: 1275 |
| >gRNA395 | gttttttagctcatgaaatt | SEQ ID NO: 1276 |
| >gRNA396 | agctcatgaaattaggtaca | SEQ ID NO: 1277 |
| >gRNA397 | catgaaattaggtacaaagt | SEQ ID NO: 1278 |
| >gRNA398 | tgaaattaggtacaaagtca | SEQ ID NO: 1279 |
| >gRNA399 | aaattaggtacaaagtcaga | SEQ ID NO: 1280 |
| >gRNA400 | aattaggtacaaagtcagag | SEQ ID NO: 1281 |
| >gRNA401 | attaggtacaaagtcagaga | SEQ ID NO: 1282 |
| >gRNA402 | ttaggtacaaagtcagagag | SEQ ID NO: 1283 |
| >gRNA403 | tacaaagtcagagagggtc | SEQ ID NO: 1284 |
| >gRNA404 | gggtctggcatataaaacct | SEQ ID NO: 1285 |
| >gRNA405 | tctggcatataaaacctcag | SEQ ID NO: 1286 |
| >gRNA406 | ataaaacctcagcagaaata | SEQ ID NO: 1287 |
| >gRNA407 | aaaacctcagcagaaataaa | SEQ ID NO: 1288 |
| >gRNA408 | aaacctcagcagaaataaag | SEQ ID NO: 1289 |
| >gRNA409 | aataaagaggttttgttgtt | SEQ ID NO: 1290 |

FIG. 3 cont.

| | | |
|---|---|---|
| >gRNA410 | aagaggttttgttgtttggt | SEQ ID NO: 1291 |
| >gRNA411 | tgtttggtaagaacatacct | SEQ ID NO: 1292 |
| >gRNA412 | gtttggtaagaacataccttt | SEQ ID NO: 1293 |
| >gRNA413 | ggtaagaacataccttgggt | SEQ ID NO: 1294 |
| >gRNA414 | agaacataccttgggttggt | SEQ ID NO: 1295 |
| >gRNA415 | gaacataccttgggttggtt | SEQ ID NO: 1296 |
| >gRNA416 | taccttgggttggttgggca | SEQ ID NO: 1297 |
| >gRNA417 | cttgggttggttgggcacgg | SEQ ID NO: 1298 |
| >gRNA418 | tgcctgtaatcccaacactt | SEQ ID NO: 1299 |
| >gRNA419 | gcctgtaatcccaacacttt | SEQ ID NO: 1300 |
| >gRNA420 | ctgtaatcccaacactttgg | SEQ ID NO: 1301 |
| >gRNA421 | tgtaatcccaacactttggg | SEQ ID NO: 1302 |
| >gRNA422 | tcccaacactttgggaggcc | SEQ ID NO: 1303 |
| >gRNA423 | cccaacactttgggaggcca | SEQ ID NO: 1304 |
| >gRNA424 | aacactttgggaggccaagg | SEQ ID NO: 1305 |
| >gRNA425 | acactttgggaggccaaggc | SEQ ID NO: 1306 |
| >gRNA426 | caaggcaggctgatcacttg | SEQ ID NO: 1307 |
| >gRNA427 | gcaggctgatcacttgaagt | SEQ ID NO: 1308 |
| >gRNA428 | caggctgatcacttgaagtt | SEQ ID NO: 1309 |
| >gRNA429 | ggctgatcacttgaagttgg | SEQ ID NO: 1310 |
| >gRNA430 | tcacttgaagttgggagttc | SEQ ID NO: 1311 |
| >gRNA431 | tgaagttgggagttcaagac | SEQ ID NO: 1312 |
| >gRNA432 | ttgggagttcaagaccagcc | SEQ ID NO: 1313 |
| >gRNA433 | caagaccagcctggccaaca | SEQ ID NO: 1314 |
| >gRNA434 | ctgaaaatacaaaaattaac | SEQ ID NO: 1315 |
| >gRNA435 | tgaaaatacaaaaattaacc | SEQ ID NO: 1316 |
| >gRNA436 | atacaaaattaaccaggca | SEQ ID NO: 1317 |
| >gRNA437 | caaaaattaaccaggcatgg | SEQ ID NO: 1318 |
| >gRNA438 | ggcatggtggtgtgtgcctg | SEQ ID NO: 1319 |
| >gRNA439 | gtggtgtgtgcctgtagtcc | SEQ ID NO: 1320 |
| >gRNA440 | tggtgtgtgcctgtagtccc | SEQ ID NO: 1321 |
| >gRNA441 | tcccaggaatcacttgaacc | SEQ ID NO: 1322 |
| >gRNA442 | cccaggaatcacttgaaccc | SEQ ID NO: 1323 |
| >gRNA443 | caggaatcacttgaacccag | SEQ ID NO: 1324 |
| >gRNA444 | aggaatcacttgaacccagg | SEQ ID NO: 1325 |
| >gRNA445 | aatcacttgaacccaggagg | SEQ ID NO: 1326 |
| >gRNA446 | tcacttgaacccaggaggcg | SEQ ID NO: 1327 |
| >gRNA447 | cacttgaacccaggaggcgg | SEQ ID NO: 1328 |
| >gRNA448 | aacccaggaggcggaggttg | SEQ ID NO: 1329 |
| >gRNA449 | caggaggcggaggttgcagt | SEQ ID NO: 1330 |
| >gRNA450 | ggcggaggttgcagtgagct | SEQ ID NO: 1331 |

FIG. 3 cont.

| >gRNA451 | caccactgcacactgcactc | SEQ ID NO: 1332 |
| >gRNA452 | ctgcacactgcactccagcc | SEQ ID NO: 1333 |
| >gRNA453 | tgcacactgcactccagcct | SEQ ID NO: 1334 |
| >gRNA454 | ctgcactccagcctgggcaa | SEQ ID NO: 1335 |
| >gRNA455 | tccagcctgggcaatggaat | SEQ ID NO: 1336 |
| >gRNA456 | aataaaaaataaaaaaata | SEQ ID NO: 1337 |
| >gRNA457 | aaaaataaagaacatacct | SEQ ID NO: 1338 |
| >gRNA458 | aaaaataaagaacatacctt | SEQ ID NO: 1339 |
| >gRNA459 | ataccttgggttgatccact | SEQ ID NO: 1340 |
| >gRNA460 | taccttgggttgatccactt | SEQ ID NO: 1341 |
| >gRNA461 | gttgatccacttaggaacct | SEQ ID NO: 1342 |
| >gRNA462 | ataataacatctgccacgta | SEQ ID NO: 1343 |
| >gRNA463 | aataacatctgccacgtata | SEQ ID NO: 1344 |
| >gRNA464 | atagagcaattgctatgtcc | SEQ ID NO: 1345 |
| >gRNA465 | tagagcaattgctatgtccc | SEQ ID NO: 1346 |
| >gRNA466 | ctatgtcccaggcactctac | SEQ ID NO: 1347 |
| >gRNA467 | actctactagacacttcata | SEQ ID NO: 1348 |
| >gRNA468 | actagacacttcatacagtt | SEQ ID NO: 1349 |
| >gRNA469 | cttcatacagtttagaaaat | SEQ ID NO: 1350 |
| >gRNA470 | atacagtttagaaaatcaga | SEQ ID NO: 1351 |
| >gRNA471 | tacagtttagaaaatcagat | SEQ ID NO: 1352 |
| >gRNA472 | tttagaaaatcagatgggtg | SEQ ID NO: 1353 |
| >gRNA473 | aaatcagatgggtgtagatc | SEQ ID NO: 1354 |
| >gRNA474 | aatcagatgggtgtagatca | SEQ ID NO: 1355 |
| >gRNA475 | cagatgggtgtagatcaagg | SEQ ID NO: 1356 |
| >gRNA476 | agatgggtgtagatcaaggc | SEQ ID NO: 1357 |
| >gRNA477 | atgggtgtagatcaaggcag | SEQ ID NO: 1358 |
| >gRNA478 | ggtgtagatcaaggcaggag | SEQ ID NO: 1359 |
| >gRNA479 | gtgtagatcaaggcaggagc | SEQ ID NO: 1360 |
| >gRNA480 | aggcaggagcaggaaccaaa | SEQ ID NO: 1361 |
| >gRNA481 | aggagcaggaaccaaaaaga | SEQ ID NO: 1362 |
| >gRNA482 | ggagcaggaaccaaaaagaa | SEQ ID NO: 1363 |
| >gRNA483 | aaaaagaaaggcataaacat | SEQ ID NO: 1364 |
| >gRNA484 | cataaacataagaaaaaaaa | SEQ ID NO: 1365 |
| >gRNA485 | aaacataagaaaaaaaatgg | SEQ ID NO: 1366 |
| >gRNA486 | aacataagaaaaaaaatgga | SEQ ID NO: 1367 |
| >gRNA487 | acataagaaaaaaatggaa | SEQ ID NO: 1368 |
| >gRNA488 | cataagaaaaaaaatggaag | SEQ ID NO: 1369 |
| >gRNA489 | aagaaaaaaatggaagggg | SEQ ID NO: 1370 |
| >gRNA490 | aaaatggaagggggtggaaa | SEQ ID NO: 1371 |
| >gRNA491 | aaatggaagggggtggaaaca | SEQ ID NO: 1372 |

FIG. 3 cont.

| >gRNA492 | gaaacagagtacaataacat | SEQ ID NO: 1373 |
|---|---|---|
| >gRNA493 | caataacatgagtaatttga | SEQ ID NO: 1374 |
| >gRNA494 | aataacatgagtaatttgat | SEQ ID NO: 1375 |
| >gRNA495 | ataacatgagtaatttgatg | SEQ ID NO: 1376 |
| >gRNA496 | taacatgagtaatttgatgg | SEQ ID NO: 1377 |
| >gRNA497 | gatgggggctattatgaact | SEQ ID NO: 1378 |
| >gRNA498 | actgagaaatgaactttgaa | SEQ ID NO: 1379 |
| >gRNA499 | atgaactttgaaaagtatct | SEQ ID NO: 1380 |
| >gRNA500 | tgaactttgaaaagtatctt | SEQ ID NO: 1381 |
| >gRNA501 | gaactttgaaaagtatcttg | SEQ ID NO: 1382 |
| >gRNA502 | tatcttggggccaaatcatg | SEQ ID NO: 1383 |
| >gRNA503 | gccaaatcatgtagactctt | SEQ ID NO: 1384 |
| >gRNA504 | agactcttgagtgatgtgtt | SEQ ID NO: 1385 |
| >gRNA505 | gactcttgagtgatgtgtta | SEQ ID NO: 1386 |
| >gRNA506 | gatgtgttaaggaatgctat | SEQ ID NO: 1387 |
| >gRNA507 | taaggaatgctatgagtgct | SEQ ID NO: 1388 |
| >gRNA508 | aggaatgctatgagtgctga | SEQ ID NO: 1389 |
| >gRNA509 | ggaatgctatgagtgctgag | SEQ ID NO: 1390 |
| >gRNA510 | gaatgctatgagtgctgaga | SEQ ID NO: 1391 |
| >gRNA511 | tatgagtgctgagagggcat | SEQ ID NO: 1392 |
| >gRNA512 | gagtgctgagagggcatcag | SEQ ID NO: 1393 |
| >gRNA513 | agagggcatcagaagtcctt | SEQ ID NO: 1394 |
| >gRNA514 | agggcatcagaagtccttga | SEQ ID NO: 1395 |
| >gRNA515 | cagaagtccttgagagcctc | SEQ ID NO: 1396 |
| >gRNA516 | gaagtccttgagagcctcca | SEQ ID NO: 1397 |
| >gRNA517 | tccttgagagcctccagaga | SEQ ID NO: 1398 |
| >gRNA518 | ccttgagagcctccagagaa | SEQ ID NO: 1399 |
| >gRNA519 | gagaaaggctcttaaaaatg | SEQ ID NO: 1400 |
| >gRNA520 | taaaaatgcagcgcaatctc | SEQ ID NO: 1401 |
| >gRNA521 | tgcagcgcaatctccagtga | SEQ ID NO: 1402 |
| >gRNA522 | agcgcaatctccagtgacag | SEQ ID NO: 1403 |
| >gRNA523 | ccagtgacagaagatactgc | SEQ ID NO: 1404 |
| >gRNA524 | agatactgctagaaatctgc | SEQ ID NO: 1405 |
| >gRNA525 | ctgctagaaaaaaacaaaa | SEQ ID NO: 1406 |
| >gRNA526 | tgctagaaaaaaacaaaaa | SEQ ID NO: 1407 |
| >gRNA527 | aaaaacaaaaaaggcatgta | SEQ ID NO: 1408 |
| >gRNA528 | aaacaaaaaaggcatgtata | SEQ ID NO: 1409 |
| >gRNA529 | aacaaaaaaggcatgtatag | SEQ ID NO: 1410 |
| >gRNA530 | ggcatgtatagaggaattat | SEQ ID NO: 1411 |
| >gRNA531 | gcatgtatagaggaattatg | SEQ ID NO: 1412 |
| >gRNA532 | catgtatagaggaattatga | SEQ ID NO: 1413 |

FIG. 3 cont.

| | | |
|---|---|---|
| >gRNA533 | tatagaggaattatgaggga | SEQ ID NO: 1414 |
| >gRNA534 | aattatgagggaaagatacc | SEQ ID NO: 1415 |
| >gRNA535 | gagggaaagataccaagtca | SEQ ID NO: 1416 |
| >gRNA536 | tcacggtttattcttcaaaa | SEQ ID NO: 1417 |
| >gRNA537 | acggtttattcttcaaaatg | SEQ ID NO: 1418 |
| >gRNA538 | cggtttattcttcaaaatgg | SEQ ID NO: 1419 |
| >gRNA539 | tttattcttcaaaatggagg | SEQ ID NO: 1420 |
| >gRNA540 | tcaaaatggaggtggcttgt | SEQ ID NO: 1421 |
| >gRNA541 | caaaatggaggtggcttgtt | SEQ ID NO: 1422 |
| >gRNA542 | aatggaggtggcttgttggg | SEQ ID NO: 1423 |
| >gRNA543 | atggaggtggcttgttggga | SEQ ID NO: 1424 |
| >gRNA544 | gaggtggcttgttgggaagg | SEQ ID NO: 1425 |
| >gRNA545 | gtggcttgttgggaaggtgg | SEQ ID NO: 1426 |
| >gRNA546 | tgggaaggtggaagctcatt | SEQ ID NO: 1427 |
| >gRNA547 | aaggtggaagctcatttggc | SEQ ID NO: 1428 |
| >gRNA548 | ggtggaagctcatttggcca | SEQ ID NO: 1429 |
| >gRNA549 | ggaagctcatttggccagag | SEQ ID NO: 1430 |
| >gRNA550 | tcatttggccagagtggaaa | SEQ ID NO: 1431 |
| >gRNA551 | ggccagagtggaaatggaat | SEQ ID NO: 1432 |
| >gRNA552 | gccagagtggaaatggaatt | SEQ ID NO: 1433 |
| >gRNA553 | cagagtggaaatggaattgg | SEQ ID NO: 1434 |
| >gRNA554 | gatgaccaaatgtaaacact | SEQ ID NO: 1435 |
| >gRNA555 | taaacacttggtgcctgata | SEQ ID NO: 1436 |
| >gRNA556 | gcctgatatagcttgacacc | SEQ ID NO: 1437 |
| >gRNA557 | gatatagcttgacaccaagt | SEQ ID NO: 1438 |
| >gRNA558 | cttgacaccaagttagcccc | SEQ ID NO: 1439 |
| >gRNA559 | tagccccaagtgaaataccc | SEQ ID NO: 1440 |
| >gRNA560 | tgtcttttcccgatattcct | SEQ ID NO: 1441 |
| >gRNA561 | gtcttttcccgatattcctc | SEQ ID NO: 1442 |
| >gRNA562 | gatattcctcaggtactcca | SEQ ID NO: 1443 |
| >gRNA563 | cctcaggtactccaaagatt | SEQ ID NO: 1444 |
| >gRNA564 | ctcaggtactccaaagattc | SEQ ID NO: 1445 |
| >gRNA565 | tcaggtttactcacgtcatc | SEQ ID NO: 1446 |
| >gRNA566 | ggtttactcacgtcatccag | SEQ ID NO: 1447 |
| >gRNA567 | tttactcacgtcatccagca | SEQ ID NO: 1448 |
| >gRNA568 | tcacgtcatccagcagagaa | SEQ ID NO: 1449 |
| >gRNA569 | gtcatccagcagagaatgga | SEQ ID NO: 1450 |
| >gRNA570 | ttcctgaattgctatgtgtc | SEQ ID NO: 1451 |
| >gRNA571 | tcctgaattgctatgtgtct | SEQ ID NO: 1452 |
| >gRNA572 | gtttcatccatccgacattg | SEQ ID NO: 1453 |
| >gRNA573 | acattgaagttgacttactg | SEQ ID NO: 1454 |

FIG. 3 cont.

| | | |
|---|---|---|
| >gRNA574 | gaagttgacttactgaagaa | SEQ ID NO: 1455 |
| >gRNA575 | agttgacttactgaagaatg | SEQ ID NO: 1456 |
| >gRNA576 | ttgacttactgaagaatgga | SEQ ID NO: 1457 |
| >gRNA577 | gacttactgaagaatggaga | SEQ ID NO: 1458 |
| >gRNA578 | gaatggagagagaattgaaa | SEQ ID NO: 1459 |
| >gRNA579 | tggagagagaattgaaaaag | SEQ ID NO: 1460 |
| >gRNA580 | gagagagaattgaaaaagtg | SEQ ID NO: 1461 |
| >gRNA581 | aattgaaaaagtggagcatt | SEQ ID NO: 1462 |
| >gRNA582 | gagcattcagacttgtcttt | SEQ ID NO: 1463 |
| >gRNA583 | attcagacttgtctttcagc | SEQ ID NO: 1464 |
| >gRNA584 | ttcagacttgtctttcagca | SEQ ID NO: 1465 |
| >gRNA585 | acttgtctttcagcaaggac | SEQ ID NO: 1466 |
| >gRNA586 | tgaattcaccccactgaaa | SEQ ID NO: 1467 |
| >gRNA587 | tcaccccactgaaaaagat | SEQ ID NO: 1468 |
| >gRNA588 | tgaaccatgtgactttgtca | SEQ ID NO: 1469 |
| >gRNA589 | atgtgactttgtcacagccc | SEQ ID NO: 1470 |
| >gRNA590 | gactttgtcacagcccaaga | SEQ ID NO: 1471 |
| >gRNA591 | tgtcacagcccaagatagtt | SEQ ID NO: 1472 |
| >gRNA592 | cacagcccaagatagttaag | SEQ ID NO: 1473 |
| >gRNA593 | acagcccaagatagttaagt | SEQ ID NO: 1474 |
| >gRNA594 | cagcccaagatagttaagtg | SEQ ID NO: 1475 |
| >gRNA595 | ccaagatagttaagtggggt | SEQ ID NO: 1476 |
| >gRNA596 | taagtcttacattcttttgt | SEQ ID NO: 1477 |
| >gRNA597 | attcttttgtaagctgctga | SEQ ID NO: 1478 |
| >gRNA598 | agctgctgaaagttgtgtat | SEQ ID NO: 1479 |
| >gRNA599 | tgctgaaagttgtgtatgag | SEQ ID NO: 1480 |
| >gRNA600 | gtatgagtagtcatatcata | SEQ ID NO: 1481 |
| >gRNA601 | aaagctgctttgatataaaa | SEQ ID NO: 1482 |
| >gRNA602 | aagctgctttgatataaaaa | SEQ ID NO: 1483 |
| >gRNA603 | tttgatataaaaaaggtcta | SEQ ID NO: 1484 |
| >gRNA604 | atggccatactaccctgaat | SEQ ID NO: 1485 |
| >gRNA605 | gatataaacaatctgcatat | SEQ ID NO: 1486 |
| >gRNA606 | atataaacaatctgcatatt | SEQ ID NO: 1487 |
| >gRNA607 | aatctgcatattgggattgt | SEQ ID NO: 1488 |
| >gRNA608 | atctgcatattgggattgtc | SEQ ID NO: 1489 |
| >gRNA609 | tctgcatattgggattgtca | SEQ ID NO: 1490 |
| >gRNA610 | attgtcagggaatgttctta | SEQ ID NO: 1491 |
| >gRNA611 | cagggaatgttcttaaagat | SEQ ID NO: 1492 |
| >gRNA612 | aatgttcttaaagatcagat | SEQ ID NO: 1493 |
| >gRNA613 | gttcttaaagatcagattag | SEQ ID NO: 1494 |
| >gRNA614 | tcagattagtggcacctgct | SEQ ID NO: 1495 |

FIG. 3 cont.

| | | |
|---|---|---|
| >gRNA615 | cctgctgagatactgatgca | SEQ ID NO: 1496 |
| >gRNA616 | tgagatactgatgcacagca | SEQ ID NO: 1497 |
| >gRNA617 | gcacagcatggtttctgaac | SEQ ID NO: 1498 |
| >gRNA618 | cagcatggtttctgaaccag | SEQ ID NO: 1499 |
| >gRNA619 | ctgaaccagtagtttccctg | SEQ ID NO: 1500 |
| >gRNA620 | ccagtagtttccctgcagtt | SEQ ID NO: 1501 |
| >gRNA621 | gtagtttccctgcagttgag | SEQ ID NO: 1502 |
| >gRNA622 | tagtttccctgcagttgagc | SEQ ID NO: 1503 |
| >gRNA623 | agtttccctgcagttgagca | SEQ ID NO: 1504 |
| >gRNA624 | tttccctgcagttgagcagg | SEQ ID NO: 1505 |
| >gRNA625 | ccctgcagttgagcagggag | SEQ ID NO: 1506 |
| >gRNA626 | tgcagttgagcagggagcag | SEQ ID NO: 1507 |
| >gRNA627 | agttgagcagggagcagcag | SEQ ID NO: 1508 |
| >gRNA628 | tcttaacacttcttacctac | SEQ ID NO: 1509 |
| >gRNA629 | tcttacctactggcttcctc | SEQ ID NO: 1510 |
| >gRNA630 | ctggcttcctctagcttttg | SEQ ID NO: 1511 |
| >gRNA631 | gcttcctctagcttttgtgg | SEQ ID NO: 1512 |
| >gRNA632 | tctagcttttgtggcagctt | SEQ ID NO: 1513 |
| >gRNA633 | ctagcttttgtggcagcttc | SEQ ID NO: 1514 |
| >gRNA634 | gtggcagcttcaggtatatt | SEQ ID NO: 1515 |
| >gRNA635 | tagcactgaacgaacatctc | SEQ ID NO: 1516 |
| >gRNA636 | cactgaacgaacatctcaag | SEQ ID NO: 1517 |
| >gRNA637 | actgaacgaacatctcaaga | SEQ ID NO: 1518 |
| >gRNA638 | acgaacatctcaagaaggta | SEQ ID NO: 1519 |
| >gRNA639 | cgaacatctcaagaaggtat | SEQ ID NO: 1520 |
| >gRNA640 | aggtataggcctttgtttgt | SEQ ID NO: 1521 |
| >gRNA641 | gtttgtaagtcctgctgtcc | SEQ ID NO: 1522 |
| >gRNA642 | gtcctagcatcctataatcc | SEQ ID NO: 1523 |
| >gRNA643 | cctataatcctggacttctc | SEQ ID NO: 1524 |
| >gRNA644 | tggacttctccagtactttc | SEQ ID NO: 1525 |
| >gRNA645 | cttctccagtactttctggc | SEQ ID NO: 1526 |
| >gRNA646 | ccagtactttctggctggat | SEQ ID NO: 1527 |
| >gRNA647 | ttctggctggattggtatct | SEQ ID NO: 1528 |
| >gRNA648 | tctggctggattggtatctg | SEQ ID NO: 1529 |
| >gRNA649 | gctggattggtatctgaggc | SEQ ID NO: 1530 |
| >gRNA650 | ggattggtatctgaggctag | SEQ ID NO: 1531 |
| >gRNA651 | gattggtatctgaggctagt | SEQ ID NO: 1532 |
| >gRNA652 | tggtatctgaggctagtagg | SEQ ID NO: 1533 |
| >gRNA653 | ggtatctgaggctagtagga | SEQ ID NO: 1534 |
| >gRNA654 | gtatctgaggctagtaggaa | SEQ ID NO: 1535 |
| >gRNA655 | taggaagggcttgttcctgc | SEQ ID NO: 1536 |

FIG. 3 cont.

| >gRNA656 | aggaagggcttgttcctgct | SEQ ID NO: 1537 |
| --- | --- | --- |
| >gRNA657 | aagggcttgttcctgctggg | SEQ ID NO: 1538 |
| >gRNA658 | agctctaaacaatgtattca | SEQ ID NO: 1539 |
| >gRNA659 | gctctaaacaatgtattcat | SEQ ID NO: 1540 |
| >gRNA660 | ctaaacaatgtattcatggg | SEQ ID NO: 1541 |
| >gRNA661 | taaacaatgtattcatgggt | SEQ ID NO: 1542 |
| >gRNA662 | aatgtattcatgggtaggaa | SEQ ID NO: 1543 |
| >gRNA663 | gtattcatgggtaggaacag | SEQ ID NO: 1544 |
| >gRNA664 | ggaacagcagcctattctgc | SEQ ID NO: 1545 |
| >gRNA665 | agccttatttctaaccattt | SEQ ID NO: 1546 |
| >gRNA666 | taaccattttagacatttgt | SEQ ID NO: 1547 |
| >gRNA667 | tttagacatttgttagtaca | SEQ ID NO: 1548 |
| >gRNA668 | gttagtacatggtattttaa | SEQ ID NO: 1549 |
| >gRNA669 | tttctccactgtctttttca | SEQ ID NO: 1550 |
| >gRNA670 | cactgtctttttcatagatc | SEQ ID NO: 1551 |
| >gRNA671 | tttcatagatcgagacatgt | SEQ ID NO: 1552 |
| >gRNA672 | catagatcgagacatgtaag | SEQ ID NO: 1553 |
| >gRNA673 | gagacatgtaagcagcatca | SEQ ID NO: 1554 |
| >gRNA674 | gacatgtaagcagcatcatg | SEQ ID NO: 1555 |
| >gRNA675 | acatgtaagcagcatcatgg | SEQ ID NO: 1556 |
| >gRNA676 | gtaagcagcatcatggaggt | SEQ ID NO: 1557 |
| >gRNA677 | ggaggtaagttttgacctt | SEQ ID NO: 1558 |
| >gRNA678 | tgtttttgtttcactgtcct | SEQ ID NO: 1559 |
| >gRNA679 | gtttttgtttcactgtcctg | SEQ ID NO: 1560 |
| >gRNA680 | actgtcctgaggactattta | SEQ ID NO: 1561 |
| >gRNA681 | tcctgaggactatttataga | SEQ ID NO: 1562 |
| >gRNA682 | acatgataaccctcactatg | SEQ ID NO: 1563 |
| >gRNA683 | atgataaccctcactatgtg | SEQ ID NO: 1564 |
| >gRNA684 | cactatgtggagaacattga | SEQ ID NO: 1565 |
| >gRNA685 | ctatgtggagaacattgaca | SEQ ID NO: 1566 |
| >gRNA686 | acattgacagagtaacattt | SEQ ID NO: 1567 |
| >gRNA687 | ttgacagagtaacatttag | SEQ ID NO: 1568 |
| >gRNA688 | tgacagagtaacattttagc | SEQ ID NO: 1569 |
| >gRNA689 | gacagagtaacattttagca | SEQ ID NO: 1570 |
| >gRNA690 | gagtaacattttagcaggga | SEQ ID NO: 1571 |
| >gRNA691 | taacattttagcagggaaag | SEQ ID NO: 1572 |
| >gRNA692 | gcagggaaagaagaatccta | SEQ ID NO: 1573 |
| >gRNA693 | cagggaaagaagaatcctac | SEQ ID NO: 1574 |
| >gRNA694 | agggaaagaagaatcctaca | SEQ ID NO: 1575 |
| >gRNA695 | ggtcatgttcccttctcctg | SEQ ID NO: 1576 |
| >gRNA696 | tcatgttcccttctcctgtg | SEQ ID NO: 1577 |

FIG. 3 cont.

| | | |
|---|---|---|
| >gRNA697 | tgttcccttctcctgtggag | SEQ ID NO: 1578 |
| >gRNA698 | ttctcctgtggagtggcatg | SEQ ID NO: 1579 |
| >gRNA699 | tcctgtggagtggcatgaag | SEQ ID NO: 1580 |
| >gRNA700 | cctgtggagtggcatgaaga | SEQ ID NO: 1581 |
| >gRNA701 | agtggcatgaagaaggtgta | SEQ ID NO: 1582 |
| >gRNA702 | atgaagaaggtgtatggccc | SEQ ID NO: 1583 |
| >gRNA703 | tgaagaaggtgtatggcccc | SEQ ID NO: 1584 |
| >gRNA704 | aaggtgtatggccccaggta | SEQ ID NO: 1585 |
| >gRNA705 | gccatattactgaccctcta | SEQ ID NO: 1586 |
| >gRNA706 | catattactgaccctctaca | SEQ ID NO: 1587 |
| >gRNA707 | tattactgaccctctacaga | SEQ ID NO: 1588 |
| >gRNA708 | attactgaccctctacagag | SEQ ID NO: 1589 |
| >gRNA709 | ttactgaccctctacagaga | SEQ ID NO: 1590 |
| >gRNA710 | gaccctctacagagagggca | SEQ ID NO: 1591 |
| >gRNA711 | accctctacagagagggcaa | SEQ ID NO: 1592 |
| >gRNA712 | agagagggcaaaggaactgc | SEQ ID NO: 1593 |
| >gRNA713 | gggcaaaggaactgccagta | SEQ ID NO: 1594 |
| >gRNA714 | gaactgccagtatggtattg | SEQ ID NO: 1595 |
| >gRNA715 | aactgccagtatggtattgc | SEQ ID NO: 1596 |
| >gRNA716 | cagtatggtattgcaggata | SEQ ID NO: 1597 |
| >gRNA717 | agtatggtattgcaggataa | SEQ ID NO: 1598 |
| >gRNA718 | atggtattgcaggataaagg | SEQ ID NO: 1599 |
| >gRNA719 | tggtattgcaggataaaggc | SEQ ID NO: 1600 |
| >gRNA720 | tattgcaggataaaggcagg | SEQ ID NO: 1601 |
| >gRNA721 | tggttacccacattacctgc | SEQ ID NO: 1602 |
| >gRNA722 | ggttacccacattacctgca | SEQ ID NO: 1603 |
| >gRNA723 | ttcttctgccatttccacat | SEQ ID NO: 1604 |
| >gRNA724 | ccacattggacatctctgct | SEQ ID NO: 1605 |
| >gRNA725 | cacattggacatctctgctg | SEQ ID NO: 1606 |
| >gRNA726 | cattggacatctctgctgag | SEQ ID NO: 1607 |
| >gRNA727 | ttggacatctctgctgagga | SEQ ID NO: 1608 |
| >gRNA728 | tataatgttgttttattctt | SEQ ID NO: 1609 |
| >gRNA729 | atgttgttttattcttcaga | SEQ ID NO: 1610 |
| >gRNA730 | ttgttttattcttcagacag | SEQ ID NO: 1611 |
| >gRNA731 | gttttattcttcagacagaa | SEQ ID NO: 1612 |
| >gRNA732 | tttattcttcagacagaaga | SEQ ID NO: 1613 |
| >gRNA733 | ttattcttcagacagaagag | SEQ ID NO: 1614 |
| >gRNA734 | attcttcagacagaagagag | SEQ ID NO: 1615 |
| >gRNA735 | gacagaagagaggagttata | SEQ ID NO: 1616 |
| >gRNA736 | agaggagttatacagctctg | SEQ ID NO: 1617 |
| >gRNA737 | gcagacatcccattcctgta | SEQ ID NO: 1618 |

FIG. 3 cont.

| | | |
|---|---|---|
| >gRNA738 | cagacatcccattcctgtat | SEQ ID NO: 1619 |
| >gRNA739 | agacatcccattcctgtatg | SEQ ID NO: 1620 |
| >gRNA740 | tggggactgtgtttgcctct | SEQ ID NO: 1621 |
| >gRNA741 | gggactgtgtttgcctctta | SEQ ID NO: 1622 |
| >gRNA742 | ggactgtgtttgcctcttag | SEQ ID NO: 1623 |
| >gRNA743 | gtttgcctcttagaggttcc | SEQ ID NO: 1624 |
| >gRNA744 | tttgcctcttagaggttccc | SEQ ID NO: 1625 |
| >gRNA745 | cttagaggttcccaggccac | SEQ ID NO: 1626 |
| >gRNA746 | tagaggttcccaggccacta | SEQ ID NO: 1627 |
| >gRNA747 | agaggttcccaggccactag | SEQ ID NO: 1628 |
| >gRNA748 | aggttcccaggccactagag | SEQ ID NO: 1629 |
| >gRNA749 | ccaggccactagaggagata | SEQ ID NO: 1630 |
| >gRNA750 | caggccactagaggagataa | SEQ ID NO: 1631 |
| >gRNA751 | aggccactagaggagataaa | SEQ ID NO: 1632 |
| >gRNA752 | ctagaggagataaagggaaa | SEQ ID NO: 1633 |
| >gRNA753 | ttgatataatgatactataa | SEQ ID NO: 1634 |
| >gRNA754 | actataatagatgtaactac | SEQ ID NO: 1635 |
| >gRNA755 | ctataatagatgtaactaca | SEQ ID NO: 1636 |
| >gRNA756 | ataatagatgtaactacaag | SEQ ID NO: 1637 |
| >gRNA757 | gatgtaactacaaggagctc | SEQ ID NO: 1638 |
| >gRNA758 | gtaactacaaggagctccag | SEQ ID NO: 1639 |
| >gRNA759 | ctacaaggagctccagaagc | SEQ ID NO: 1640 |
| >gRNA760 | acaaggagctccagaagcaa | SEQ ID NO: 1641 |
| >gRNA761 | aaggagctccagaagcaaga | SEQ ID NO: 1642 |
| >gRNA762 | ggagctccagaagcaagaga | SEQ ID NO: 1643 |
| >gRNA763 | gagctccagaagcaagagag | SEQ ID NO: 1644 |
| >gRNA764 | agctccagaagcaagagaga | SEQ ID NO: 1645 |
| >gRNA765 | ctccagaagcaagagagagg | SEQ ID NO: 1646 |
| >gRNA766 | tccagaagcaagagagaggg | SEQ ID NO: 1647 |
| >gRNA767 | gcaagagagagggaggaact | SEQ ID NO: 1648 |
| >gRNA768 | cttggacttctctgcatctt | SEQ ID NO: 1649 |
| >gRNA769 | gacttctctgcatctttagt | SEQ ID NO: 1650 |
| >gRNA770 | cttctctgcatctttagttg | SEQ ID NO: 1651 |
| >gRNA771 | gcatctttagttggagtcca | SEQ ID NO: 1652 |
| >gRNA772 | catctttagttggagtccaa | SEQ ID NO: 1653 |
| >gRNA773 | ttcaatgaaattctactgcc | SEQ ID NO: 1654 |
| >gRNA774 | tcaatgaaattctactgccc | SEQ ID NO: 1655 |
| >gRNA775 | caatgaaattctactgccca | SEQ ID NO: 1656 |
| >gRNA776 | tcaaatctcctgttatattc | SEQ ID NO: 1657 |
| >gRNA777 | tctcctgttatattctagaa | SEQ ID NO: 1658 |
| >gRNA778 | ctcctgttatattctagaac | SEQ ID NO: 1659 |

FIG. 3 cont.

| | | |
|---|---|---|
| >gRNA779 | tcctgttatattctagaaca | SEQ ID NO: 1660 |
| >gRNA780 | tctagaacagggaattgatt | SEQ ID NO: 1661 |
| >gRNA781 | ctagaacagggaattgattt | SEQ ID NO: 1662 |
| >gRNA782 | agaacagggaattgatttgg | SEQ ID NO: 1663 |
| >gRNA783 | aacagggaattgatttggga | SEQ ID NO: 1664 |
| >gRNA784 | gaattgatttgggagagcat | SEQ ID NO: 1665 |
| >gRNA785 | aattgatttgggagagcatc | SEQ ID NO: 1666 |
| >gRNA786 | tgatttgggagagcatcagg | SEQ ID NO: 1667 |
| >gRNA787 | gatttgggagagcatcagga | SEQ ID NO: 1668 |
| >gRNA788 | ttgggagagcatcaggaagg | SEQ ID NO: 1669 |
| >gRNA789 | aggaaggtggatgatctgcc | SEQ ID NO: 1670 |
| >gRNA790 | gatctgcccagtcacactgt | SEQ ID NO: 1671 |
| >gRNA791 | gtcacactgttagtaaattg | SEQ ID NO: 1672 |
| >gRNA792 | cacactgttagtaaattgta | SEQ ID NO: 1673 |
| >gRNA793 | ctgttagtaaattgtagagc | SEQ ID NO: 1674 |
| >gRNA794 | tgttagtaaattgtagagcc | SEQ ID NO: 1675 |
| >gRNA795 | ccaggacctgaactctaata | SEQ ID NO: 1676 |
| >gRNA796 | agtcatgtgttacttaatga | SEQ ID NO: 1677 |
| >gRNA797 | gtcatgtgttacttaatgac | SEQ ID NO: 1678 |
| >gRNA798 | tcatgtgttacttaatgacg | SEQ ID NO: 1679 |
| >gRNA799 | taatgacggggacatgttct | SEQ ID NO: 1680 |
| >gRNA800 | gagaaatgcttacacaaacc | SEQ ID NO: 1681 |
| >gRNA801 | agaaatgcttacacaaacct | SEQ ID NO: 1682 |
| >gRNA802 | ttacacaaacctaggtgttg | SEQ ID NO: 1683 |
| >gRNA803 | gttgtagcctactacacgca | SEQ ID NO: 1684 |
| >gRNA804 | ttgtagcctactacacgcat | SEQ ID NO: 1685 |
| >gRNA805 | tactacacgcataggctaca | SEQ ID NO: 1686 |
| >gRNA806 | cacgcataggctacatggta | SEQ ID NO: 1687 |
| >gRNA807 | atggtatagcctattgctcc | SEQ ID NO: 1688 |
| >gRNA808 | tcctagactacaaacctgta | SEQ ID NO: 1689 |
| >gRNA809 | tgttactgtactgaatactg | SEQ ID NO: 1690 |
| >gRNA810 | gttactgtactgaatactgt | SEQ ID NO: 1691 |
| >gRNA811 | actgtactgaatactgtggg | SEQ ID NO: 1692 |
| >gRNA812 | tgtgggcagttgtaacacaa | SEQ ID NO: 1693 |
| >gRNA813 | ggcagttgtaacacaatggt | SEQ ID NO: 1694 |
| >gRNA814 | agtatttgtgtatctaaaca | SEQ ID NO: 1695 |
| >gRNA815 | atttgtgtatctaaacatag | SEQ ID NO: 1696 |
| >gRNA816 | gtatctaaacatagaagttg | SEQ ID NO: 1697 |
| >gRNA817 | atatgctattttaatcttat | SEQ ID NO: 1698 |
| >gRNA818 | tgagaccactgtcatatata | SEQ ID NO: 1699 |
| >gRNA819 | cattgaccaaaacatcatat | SEQ ID NO: 1700 |

FIG. 3 cont.

| | | |
|---|---|---|
| >gRNA820 | atatcagcattttttcttct | SEQ ID NO: 1701 |
| >gRNA821 | cattttttcttctaagattt | SEQ ID NO: 1702 |
| >gRNA822 | attttttcttctaagatttt | SEQ ID NO: 1703 |
| >gRNA823 | tttttcttctaagattttgg | SEQ ID NO: 1704 |
| >gRNA824 | ctaagattttgggagcacca | SEQ ID NO: 1705 |
| >gRNA825 | taagattttgggagcaccaa | SEQ ID NO: 1706 |
| >gRNA826 | aagattttgggagcaccaaa | SEQ ID NO: 1707 |
| >gRNA827 | gcaccaaagggatacactaa | SEQ ID NO: 1708 |
| >gRNA828 | caccaaagggatacactaac | SEQ ID NO: 1709 |
| >gRNA829 | acaggatatactctttataa | SEQ ID NO: 1710 |
| >gRNA830 | caggatatactctttataat | SEQ ID NO: 1711 |
| >gRNA831 | tatactctttataatgggtt | SEQ ID NO: 1712 |
| >gRNA832 | tactctttataatgggtttg | SEQ ID NO: 1713 |
| >gRNA833 | tgggtttggagaactgtctg | SEQ ID NO: 1714 |
| >gRNA834 | ctgcagctacttcttttaaa | SEQ ID NO: 1715 |
| >gRNA835 | tgcagctacttcttttaaaa | SEQ ID NO: 1716 |
| >gRNA836 | ttttaaaaaggtgatctaca | SEQ ID NO: 1717 |
| >gRNA837 | taaaaaggtgatctacacag | SEQ ID NO: 1718 |
| >gRNA838 | gtgatctacacagtagaaat | SEQ ID NO: 1719 |
| >gRNA839 | ctacacagtagaaattagac | SEQ ID NO: 1720 |
| >gRNA840 | cagtagaaattagacaagtt | SEQ ID NO: 1721 |
| >gRNA841 | aattagacaagtttggtaat | SEQ ID NO: 1722 |
| >gRNA842 | taacttttctttttctttt | SEQ ID NO: 1723 |
| >gRNA843 | aacttttcttttcttttc | SEQ ID NO: 1724 |
| >gRNA844 | ttcttttcttttcaggtttg | SEQ ID NO: 1725 |
| >gRNA845 | aggtttgaagatgccgcatt | SEQ ID NO: 1726 |
| >gRNA846 | tgaagatgccgcatttggat | SEQ ID NO: 1727 |
| >gRNA847 | tacactttatgcacaaaatg | SEQ ID NO: 1728 |
| >gRNA848 | acactttatgcacaaaatgt | SEQ ID NO: 1729 |
| >gRNA849 | cactttatgcacaaaatgta | SEQ ID NO: 1730 |
| >gRNA850 | gggttataataatgttaaca | SEQ ID NO: 1731 |
| >gRNA851 | ctttctttataattctacttt | SEQ ID NO: 1732 |
| >gRNA852 | tctccatgtttgatgtatct | SEQ ID NO: 1733 |
| >gRNA853 | ccatgtttgatgtatctgag | SEQ ID NO: 1734 |
| >gRNA854 | catgtttgatgtatctgagc | SEQ ID NO: 1735 |
| >gRNA855 | tatctgagcaggttgctcca | SEQ ID NO: 1736 |
| >gRNA856 | atctgagcaggttgctccac | SEQ ID NO: 1737 |
| >gRNA857 | tgagcaggttgctccacagg | SEQ ID NO: 1738 |
| >gRNA858 | ggttgctccacaggtagctc | SEQ ID NO: 1739 |
| >gRNA859 | gttgctccacaggtagctct | SEQ ID NO: 1740 |
| >gRNA860 | tgctccacaggtagctctag | SEQ ID NO: 1741 |

FIG. 3 cont.

| | | |
|---|---|---|
| >gRNA861 | gctccacaggtagctctagg | SEQ ID NO: 1742 |
| >gRNA862 | ctccacaggtagctctagga | SEQ ID NO: 1743 |
| >gRNA863 | acaggtagctctaggagggc | SEQ ID NO: 1744 |
| >gRNA864 | ctctaggagggctggcaact | SEQ ID NO: 1745 |
| >gRNA865 | ctaggagggctggcaactta | SEQ ID NO: 1746 |
| >gRNA866 | taggagggctggcaacttag | SEQ ID NO: 1747 |
| >gRNA867 | gagggctggcaacttagagg | SEQ ID NO: 1748 |
| >gRNA868 | agggctggcaacttagaggt | SEQ ID NO: 1749 |
| >gRNA869 | gggctggcaacttagaggtg | SEQ ID NO: 1750 |
| >gRNA870 | gctggcaacttagaggtggg | SEQ ID NO: 1751 |
| >gRNA871 | ggcaacttagaggtggggag | SEQ ID NO: 1752 |
| >gRNA872 | caacttagaggtggggagca | SEQ ID NO: 1753 |
| >gRNA873 | cttatccaacatcaacatct | SEQ ID NO: 1754 |
| >gRNA874 | tccaacatcaacatcttggt | SEQ ID NO: 1755 |
| >gRNA875 | tcttcaatctcttgcactca | SEQ ID NO: 1756 |
| >gRNA876 | tcttgcactcaaagcttgtt | SEQ ID NO: 1757 |
| >gRNA877 | gcactcaaagcttgttaaga | SEQ ID NO: 1758 |
| >gRNA878 | caaagcttgttaagatagtt | SEQ ID NO: 1759 |
| >gRNA879 | taagatagttaagcgtgcat | SEQ ID NO: 1760 |
| >gRNA880 | tccaatttacatactctgct | SEQ ID NO: 1761 |
| >gRNA881 | tacatactctgcttagaatt | SEQ ID NO: 1762 |
| >gRNA882 | acatactctgcttagaattt | SEQ ID NO: 1763 |
| >gRNA883 | catactctgcttagaatttg | SEQ ID NO: 1764 |
| >gRNA884 | atactctgcttagaatttgg | SEQ ID NO: 1765 |
| >gRNA885 | ttagaatttgggggaaaatt | SEQ ID NO: 1766 |
| >gRNA886 | aaatttagaaatataattga | SEQ ID NO: 1767 |
| >gRNA887 | aatttagaaatataattgac | SEQ ID NO: 1768 |
| >gRNA888 | aatataattgacaggattat | SEQ ID NO: 1769 |
| >gRNA889 | aatgaaacattttgtcatat | SEQ ID NO: 1770 |
| >gRNA890 | tacttcttatacatttgata | SEQ ID NO: 1771 |
| >gRNA891 | tcttatacatttgataaagt | SEQ ID NO: 1772 |
| >gRNA892 | cttatacatttgataaagta | SEQ ID NO: 1773 |
| >gRNA893 | acatttgataaagtaaggca | SEQ ID NO: 1774 |
| >gRNA894 | gataaagtaaggcatggttg | SEQ ID NO: 1775 |
| >gRNA895 | aggcatggttgtggttaatc | SEQ ID NO: 1776 |
| >gRNA896 | ctggtttattttgttccac | SEQ ID NO: 1777 |
| >gRNA897 | attacccctttattttcaaa | SEQ ID NO: 1778 |
| >gRNA898 | ttacccctttattttcaaac | SEQ ID NO: 1779 |
| >gRNA899 | tacccctttattttcaaaca | SEQ ID NO: 1780 |
| >gRNA900 | tttattttcaaacagggaaa | SEQ ID NO: 1781 |
| >gRNA901 | tgtttccctgtttgaaaata | SEQ ID NO: 1782 |

FIG. 3 cont.

| | | |
|---|---|---|
| >gRNA902 | gtttccctgtttgaaaataa | SEQ ID NO: 1783 |
| >gRNA903 | tttccctgtttgaaaataaa | SEQ ID NO: 1784 |
| >gRNA904 | ttccctgtttgaaaataaag | SEQ ID NO: 1785 |
| >gRNA905 | gtttgaaaataaaggggtaa | SEQ ID NO: 1786 |
| >gRNA906 | tgaaaataaaggggtaatag | SEQ ID NO: 1787 |
| >gRNA907 | gaaaataaaggggtaatagt | SEQ ID NO: 1788 |
| >gRNA908 | aaataaaggggtaatagtgg | SEQ ID NO: 1789 |
| >gRNA909 | aaaggggtaatagtgggagt | SEQ ID NO: 1790 |
| >gRNA910 | taatagtgggagtgagatat | SEQ ID NO: 1791 |
| >gRNA911 | atagtgggagtgagatataa | SEQ ID NO: 1792 |
| >gRNA912 | gatataagagataacacatc | SEQ ID NO: 1793 |
| >gRNA913 | tttatgatttatttaacttg | SEQ ID NO: 1794 |
| >gRNA914 | cttgtggaacaaaaataaac | SEQ ID NO: 1795 |
| >gRNA915 | ccttactttatcaaatgtat | SEQ ID NO: 1796 |
| >gRNA916 | tactttatcaaatgtataag | SEQ ID NO: 1797 |
| >gRNA917 | taaattttcccccaaattct | SEQ ID NO: 1798 |
| >gRNA918 | attttcccccaaattctaag | SEQ ID NO: 1799 |
| >gRNA919 | tttcccccaaattctaagca | SEQ ID NO: 1800 |
| >gRNA920 | tctaagcagagtatgtaaat | SEQ ID NO: 1801 |
| >gRNA921 | aagcagagtatgtaaattgg | SEQ ID NO: 1802 |
| >gRNA922 | gcacgcttaactatcttaac | SEQ ID NO: 1803 |
| >gRNA923 | taactatcttaacaagcttt | SEQ ID NO: 1804 |
| >gRNA924 | tcttaacaagctttgagtgc | SEQ ID NO: 1805 |
| >gRNA925 | ttaacaagctttgagtgcaa | SEQ ID NO: 1806 |
| >gRNA926 | gctttgagtgcaagagattg | SEQ ID NO: 1807 |
| >gRNA927 | tttgagtgcaagagattgaa | SEQ ID NO: 1808 |
| >gRNA928 | tgaagagttcaaatctgacc | SEQ ID NO: 1809 |
| >gRNA929 | tctgaccaagatgttgatgt | SEQ ID NO: 1810 |
| >gRNA930 | ccaagatgttgatgttggat | SEQ ID NO: 1811 |
| >gRNA931 | aagatgttgatgttggataa | SEQ ID NO: 1812 |
| >gRNA932 | attctctgctccccacctct | SEQ ID NO: 1813 |
| >gRNA933 | gctccccacctctaagttgc | SEQ ID NO: 1814 |
| >gRNA934 | ctctaagttgccagccctcc | SEQ ID NO: 1815 |
| >gRNA935 | ctaagttgccagccctccta | SEQ ID NO: 1816 |
| >gRNA936 | agccctcctagagctacctg | SEQ ID NO: 1817 |
| >gRNA937 | ccctcctagagctacctgtg | SEQ ID NO: 1818 |
| >gRNA938 | tacctgtggagcaacctgct | SEQ ID NO: 1819 |
| >gRNA939 | ctgctcagatacatcaaaca | SEQ ID NO: 1820 |
| >gRNA940 | gctcagatacatcaaacatg | SEQ ID NO: 1821 |
| >gRNA941 | agatacatcaaacatggaga | SEQ ID NO: 1822 |
| >gRNA942 | aaacatggagacagcactca | SEQ ID NO: 1823 |

FIG. 3 cont.

| | | |
|---|---|---|
| >gRNA943 | catggagacagcactcaaag | SEQ ID NO: 1824 |
| >gRNA944 | gcactcaaagtagaattata | SEQ ID NO: 1825 |
| >gRNA945 | ctcaaagtagaattataaag | SEQ ID NO: 1826 |
| >gRNA946 | aaccctacattttgtgcata | SEQ ID NO: 1827 |
| >gRNA947 | acattttgtgcataaagtgt | SEQ ID NO: 1828 |
| >gRNA948 | tgcataaagtgtaagtgtat | SEQ ID NO: 1829 |
| >gRNA949 | ataagcatatcaatattaaa | SEQ ID NO: 1830 |
| >gRNA950 | gcatatcaatattaaaaagc | SEQ ID NO: 1831 |
| >gRNA951 | atcaatattaaaaagcaagc | SEQ ID NO: 1832 |
| >gRNA952 | aatattaaaaagcaagcaag | SEQ ID NO: 1833 |
| >gRNA953 | aaaagcaagcaagcagaatt | SEQ ID NO: 1834 |
| >gRNA954 | gaattcatccaatccaaatg | SEQ ID NO: 1835 |
| >gRNA955 | gcggcatcttcaaacctgaa | SEQ ID NO: 1836 |
| >gRNA956 | atcttcaaacctgaaaagaa | SEQ ID NO: 1837 |
| >gRNA957 | aaacctgaaaagaaaagaaa | SEQ ID NO: 1838 |
| >gRNA958 | aacctgaaaagaaaagaaaa | SEQ ID NO: 1839 |
| >gRNA959 | tgaaaagaaaagaaaaaggt | SEQ ID NO: 1840 |
| >gRNA960 | agcaatgaatttatttatt | SEQ ID NO: 1841 |
| >gRNA961 | aatttattttatttggattg | SEQ ID NO: 1842 |
| >gRNA962 | cttgtctaatttctactgtg | SEQ ID NO: 1843 |
| >gRNA963 | tgtgtagatcaccttttaa | SEQ ID NO: 1844 |
| >gRNA964 | gtagatcaccttttaaaag | SEQ ID NO: 1845 |
| >gRNA965 | gatcaccttttaaaagaag | SEQ ID NO: 1846 |
| >gRNA966 | cttttaaaagaagtagctg | SEQ ID NO: 1847 |
| >gRNA967 | ttaaaagaagtagctgcaga | SEQ ID NO: 1848 |
| >gRNA968 | agttctccaaaccattata | SEQ ID NO: 1849 |
| >gRNA969 | ttctccaaaccattataaa | SEQ ID NO: 1850 |
| >gRNA970 | ttataaagagtatatcctgt | SEQ ID NO: 1851 |
| >gRNA971 | atcctgttagtgtatccctt | SEQ ID NO: 1852 |
| >gRNA972 | ctttggtgctcccaaaatct | SEQ ID NO: 1853 |
| >gRNA973 | tggtgctcccaaaatcttag | SEQ ID NO: 1854 |
| >gRNA974 | aaaatgctgatatgatgttt | SEQ ID NO: 1855 |
| >gRNA975 | tatgatgttttggtcaatga | SEQ ID NO: 1856 |
| >gRNA976 | atgatggactgtatatatga | SEQ ID NO: 1857 |
| >gRNA977 | atggactgtatatatgacag | SEQ ID NO: 1858 |
| >gRNA978 | atatatgacagtggtctcat | SEQ ID NO: 1859 |
| >gRNA979 | gtggtctcataagattaaaa | SEQ ID NO: 1860 |
| >gRNA980 | tttactgcaacttctatgtt | SEQ ID NO: 1861 |
| >gRNA981 | cattgtgttacaactgccca | SEQ ID NO: 1862 |
| >gRNA982 | ttacaactgcccacagtatt | SEQ ID NO: 1863 |
| >gRNA983 | actgcccacagtattcagta | SEQ ID NO: 1864 |

FIG. 3 cont.

| | | |
|---|---|---|
| >gRNA984 | cacagtattcagtacagtaa | SEQ ID NO: 1865 |
| >gRNA985 | acagtattcagtacagtaac | SEQ ID NO: 1866 |
| >gRNA986 | cagtacagtaacaggctgta | SEQ ID NO: 1867 |
| >gRNA987 | agtacagtaacaggctgtac | SEQ ID NO: 1868 |
| >gRNA988 | taacaggctgtacaggtttg | SEQ ID NO: 1869 |
| >gRNA989 | ggctgtacaggtttgtagtc | SEQ ID NO: 1870 |
| >gRNA990 | gctgtacaggtttgtagtct | SEQ ID NO: 1871 |
| >gRNA991 | tgtacaggtttgtagtctag | SEQ ID NO: 1872 |
| >gRNA992 | ggtttgtagtctaggagcaa | SEQ ID NO: 1873 |
| >gRNA993 | gtttgtagtctaggagcaat | SEQ ID NO: 1874 |
| >gRNA994 | gagcaataggctataccatg | SEQ ID NO: 1875 |
| >gRNA995 | taccatgtagcctatgcgtg | SEQ ID NO: 1876 |
| >gRNA996 | catgtagcctatgcgtgtag | SEQ ID NO: 1877 |
| >gRNA997 | atgtagcctatgcgtgtagt | SEQ ID NO: 1878 |
| >gRNA998 | gtgtagtaggctacaacacc | SEQ ID NO: 1879 |
| >gRNA999 | tgtagtaggctacaacacct | SEQ ID NO: 1880 |
| >gRNA1000 | tacaacacctaggtttgtgt | SEQ ID NO: 1881 |
| >gRNA1001 | aggtttgtgtaagcatttct | SEQ ID NO: 1882 |
| >gRNA1002 | cagaacatgtccccgtcatt | SEQ ID NO: 1883 |
| >gRNA1003 | taagtaacacatgactatat | SEQ ID NO: 1884 |
| >gRNA1004 | agtaacacatgactatatta | SEQ ID NO: 1885 |
| >gRNA1005 | cacatgactatattagagtt | SEQ ID NO: 1886 |
| >gRNA1006 | acatgactatattagagttc | SEQ ID NO: 1887 |
| >gRNA1007 | ctatattagagttcaggtcc | SEQ ID NO: 1888 |
| >gRNA1008 | ctggctctacaatttactaa | SEQ ID NO: 1889 |
| >gRNA1009 | caatttactaacagtgtgac | SEQ ID NO: 1890 |
| >gRNA1010 | aatttactaacagtgtgact | SEQ ID NO: 1891 |
| >gRNA1011 | ttactaacagtgtgactggg | SEQ ID NO: 1892 |
| >gRNA1012 | cccaaatcaattccctgttc | SEQ ID NO: 1893 |
| >gRNA1013 | ttccctgttctagaatataa | SEQ ID NO: 1894 |
| >gRNA1014 | tccctgttctagaatataac | SEQ ID NO: 1895 |
| >gRNA1015 | cctgttctagaatataacag | SEQ ID NO: 1896 |
| >gRNA1016 | aatataacaggagatttgaa | SEQ ID NO: 1897 |
| >gRNA1017 | atataacaggagatttgaat | SEQ ID NO: 1898 |
| >gRNA1018 | tataacaggagatttgaatg | SEQ ID NO: 1899 |
| >gRNA1019 | aggagatttgaatggggttt | SEQ ID NO: 1900 |
| >gRNA1020 | gtttcagcatcaatgtaccc | SEQ ID NO: 1901 |
| >gRNA1021 | tttcagcatcaatgtaccct | SEQ ID NO: 1902 |
| >gRNA1022 | cagcatcaatgtaccctggg | SEQ ID NO: 1903 |
| >gRNA1023 | catcaatgtaccctgggcag | SEQ ID NO: 1904 |
| >gRNA1024 | ggcagtagaatttcattgaa | SEQ ID NO: 1905 |

FIG. 3 cont.

| >gRNA1025 | gaatttcattgaaaagcctt | SEQ ID NO: 1906 |
| --- | --- | --- |
| >gRNA1026 | aagcctttggactccaacta | SEQ ID NO: 1907 |
| >gRNA1027 | ttggactccaactaaagatg | SEQ ID NO: 1908 |
| >gRNA1028 | ggactccaactaaagatgca | SEQ ID NO: 1909 |
| >gRNA1029 | ctccaactaaagatgcagag | SEQ ID NO: 1910 |
| >gRNA1030 | ctaaagatgcagagaagtcc | SEQ ID NO: 1911 |
| >gRNA1031 | tcctccctctctcttgcttc | SEQ ID NO: 1912 |
| >gRNA1032 | ctccctctctcttgcttctg | SEQ ID NO: 1913 |
| >gRNA1033 | cttgcttctggagctccttg | SEQ ID NO: 1914 |
| >gRNA1034 | ccttgtagttacatctatta | SEQ ID NO: 1915 |
| >gRNA1035 | tattatagtatcattatatc | SEQ ID NO: 1916 |
| >gRNA1036 | ctgtttccctttatctcctc | SEQ ID NO: 1917 |
| >gRNA1037 | tttccctttatctcctctag | SEQ ID NO: 1918 |
| >gRNA1038 | ctttatctcctctagtggcc | SEQ ID NO: 1919 |
| >gRNA1039 | tttatctcctctagtggcct | SEQ ID NO: 1920 |
| >gRNA1040 | ctagtggcctgggaacctct | SEQ ID NO: 1921 |
| >gRNA1041 | agtggcctgggaacctctaa | SEQ ID NO: 1922 |
| >gRNA1042 | gtggcctgggaacctctaag | SEQ ID NO: 1923 |
| >gRNA1043 | gaacctctaagaggcaaaca | SEQ ID NO: 1924 |
| >gRNA1044 | aggcaaacacagtccccata | SEQ ID NO: 1925 |
| >gRNA1045 | ggcaaacacagtccccatac | SEQ ID NO: 1926 |
| >gRNA1046 | acacagtccccatacaggaa | SEQ ID NO: 1927 |
| >gRNA1047 | cacagtccccatacaggaat | SEQ ID NO: 1928 |
| >gRNA1048 | atacaggaatgggatgtctg | SEQ ID NO: 1929 |
| >gRNA1049 | acaggaatgggatgtctgca | SEQ ID NO: 1930 |
| >gRNA1050 | taactcctctcttctgtctg | SEQ ID NO: 1931 |
| >gRNA1051 | gaataaaacaacattataca | SEQ ID NO: 1932 |
| >gRNA1052 | aataaaacaacattatacaa | SEQ ID NO: 1933 |
| >gRNA1053 | aacaacattatacaaaggaa | SEQ ID NO: 1934 |
| >gRNA1054 | caacattatacaaaggaaaa | SEQ ID NO: 1935 |
| >gRNA1055 | cattatacaaaggaaaagag | SEQ ID NO: 1936 |
| >gRNA1056 | agtggttcattttctctcct | SEQ ID NO: 1937 |
| >gRNA1057 | ggttcattttctctcctcag | SEQ ID NO: 1938 |
| >gRNA1058 | ttcattttctctcctcagca | SEQ ID NO: 1939 |
| >gRNA1059 | ctcagcagagatgtccaatg | SEQ ID NO: 1940 |
| >gRNA1060 | agagatgtccaatgtggaaa | SEQ ID NO: 1941 |
| >gRNA1061 | gatgtccaatgtggaaatgg | SEQ ID NO: 1942 |
| >gRNA1062 | gtccaatgtggaaatggcag | SEQ ID NO: 1943 |
| >gRNA1063 | aatgtggaaatggcagaaga | SEQ ID NO: 1944 |
| >gRNA1064 | aaatggcagaagaaagatca | SEQ ID NO: 1945 |
| >gRNA1065 | gaagaaagatcaaagccttg | SEQ ID NO: 1946 |

FIG. 3 cont.

| | | |
|---|---|---|
| >gRNA1066 | aagaaagatcaaagccttgc | SEQ ID NO: 1947 |
| >gRNA1067 | tcaaagccttgcaggtaatg | SEQ ID NO: 1948 |
| >gRNA1068 | caaagccttgcaggtaatgt | SEQ ID NO: 1949 |
| >gRNA1069 | tttatcctgcaataccatac | SEQ ID NO: 1950 |
| >gRNA1070 | atcctgcaataccatactgg | SEQ ID NO: 1951 |
| >gRNA1071 | cagttcctttgccctctctg | SEQ ID NO: 1952 |
| >gRNA1072 | gttcctttgccctctctgta | SEQ ID NO: 1953 |
| >gRNA1073 | ttcctttgccctctctgtag | SEQ ID NO: 1954 |
| >gRNA1074 | tcctttgccctctctgtaga | SEQ ID NO: 1955 |
| >gRNA1075 | ttgccctctctgtagagggt | SEQ ID NO: 1956 |
| >gRNA1076 | tctgtagagggtcagtaata | SEQ ID NO: 1957 |
| >gRNA1077 | gtcagtaatatggccatacc | SEQ ID NO: 1958 |
| >gRNA1078 | tcagtaatatggccatacct | SEQ ID NO: 1959 |
| >gRNA1079 | cagtaatatggccatacctg | SEQ ID NO: 1960 |
| >gRNA1080 | accttcttcatgccactcca | SEQ ID NO: 1961 |
| >gRNA1081 | ccttcttcatgccactccac | SEQ ID NO: 1962 |
| >gRNA1082 | ttcttcatgccactccacag | SEQ ID NO: 1963 |
| >gRNA1083 | ttcatgccactccacaggag | SEQ ID NO: 1964 |
| >gRNA1084 | tcatgccactccacaggaga | SEQ ID NO: 1965 |
| >gRNA1085 | catgccactccacaggagaa | SEQ ID NO: 1966 |
| >gRNA1086 | gagaagggaacatgaccctg | SEQ ID NO: 1967 |
| >gRNA1087 | agaagggaacatgaccctgt | SEQ ID NO: 1968 |
| >gRNA1088 | ctctgtcaatgttctccaca | SEQ ID NO: 1969 |
| >gRNA1089 | gtcaatgttctccacatagt | SEQ ID NO: 1970 |
| >gRNA1090 | tcaatgttctccacatagtg | SEQ ID NO: 1971 |
| >gRNA1091 | caatgttctccacatagtga | SEQ ID NO: 1972 |
| >gRNA1092 | catagtgagggttatcatgt | SEQ ID NO: 1973 |
| >gRNA1093 | tagtgagggttatcatgtta | SEQ ID NO: 1974 |
| >gRNA1094 | atgttagagctgtctataaa | SEQ ID NO: 1975 |
| >gRNA1095 | agctgtctataaatagtcct | SEQ ID NO: 1976 |
| >gRNA1096 | gctgtctataaatagtcctc | SEQ ID NO: 1977 |
| >gRNA1097 | tctataaatagtcctcagga | SEQ ID NO: 1978 |
| >gRNA1098 | tgaaacaaaaacattttctc | SEQ ID NO: 1979 |
| >gRNA1099 | gaaacaaaaacattttctca | SEQ ID NO: 1980 |
| >gRNA1100 | acatgtctcgatctatgaaa | SEQ ID NO: 1981 |
| >gRNA1101 | gtctcgatctatgaaaaaga | SEQ ID NO: 1982 |
| >gRNA1102 | tcgatctatgaaaaagacag | SEQ ID NO: 1983 |
| >gRNA1103 | gatctatgaaaaagacagtg | SEQ ID NO: 1984 |
| >gRNA1104 | aaaagacagtggagaaaaaa | SEQ ID NO: 1985 |
| >gRNA1105 | aaagacagtggagaaaaaaa | SEQ ID NO: 1986 |
| >gRNA1106 | gacagtggagaaaaaaaagg | SEQ ID NO: 1987 |

FIG. 3 cont.

| | | |
|---|---|---|
| >gRNA1107 | agaaaaaaaaggaagacatt | SEQ ID NO: 1988 |
| >gRNA1108 | gtactaacaaatgtctaaaa | SEQ ID NO: 1989 |
| >gRNA1109 | taacaaatgtctaaaatggt | SEQ ID NO: 1990 |
| >gRNA1110 | tgtctaaaatggttagaaat | SEQ ID NO: 1991 |
| >gRNA1111 | gtctaaaatggttagaaata | SEQ ID NO: 1992 |
| >gRNA1112 | aaaatggttagaaataaggc | SEQ ID NO: 1993 |
| >gRNA1113 | atggttagaaataaggctgg | SEQ ID NO: 1994 |
| >gRNA1114 | tagaaataaggctggcagaa | SEQ ID NO: 1995 |
| >gRNA1115 | agaaataaggctggcagaat | SEQ ID NO: 1996 |
| >gRNA1116 | ctacccatgaatacattgtt | SEQ ID NO: 1997 |
| >gRNA1117 | acccatgaatacattgttta | SEQ ID NO: 1998 |
| >gRNA1118 | atacattgtttagagctacc | SEQ ID NO: 1999 |
| >gRNA1119 | cattgtttagagctacccag | SEQ ID NO: 2000 |
| >gRNA1120 | attgtttagagctacccagc | SEQ ID NO: 2001 |
| >gRNA1121 | tagagctacccagcaggaac | SEQ ID NO: 2002 |
| >gRNA1122 | caggaacaagcccttcctac | SEQ ID NO: 2003 |
| >gRNA1123 | caagcccttcctactagcct | SEQ ID NO: 2004 |
| >gRNA1124 | actagcctcagataccaatc | SEQ ID NO: 2005 |
| >gRNA1125 | gcctcagataccaatccagc | SEQ ID NO: 2006 |
| >gRNA1126 | cagataccaatccagccaga | SEQ ID NO: 2007 |
| >gRNA1127 | ccaatccagccagaaagtac | SEQ ID NO: 2008 |
| >gRNA1128 | aatccagccagaaagtactg | SEQ ID NO: 2009 |
| >gRNA1129 | ccagccagaaagtactggag | SEQ ID NO: 2010 |
| >gRNA1130 | cagaaagtactggagaagtc | SEQ ID NO: 2011 |
| >gRNA1131 | agaaagtactggagaagtcc | SEQ ID NO: 2012 |
| >gRNA1132 | actggagaagtccaggatta | SEQ ID NO: 2013 |
| >gRNA1133 | ctggagaagtccaggattat | SEQ ID NO: 2014 |
| >gRNA1134 | agtccaggattataggatgc | SEQ ID NO: 2015 |
| >gRNA1135 | gtccaggattataggatgct | SEQ ID NO: 2016 |
| >gRNA1136 | aggattataggatgctagga | SEQ ID NO: 2017 |
| >gRNA1137 | attataggatgctaggacag | SEQ ID NO: 2018 |
| >gRNA1138 | ttataggatgctaggacagc | SEQ ID NO: 2019 |
| >gRNA1139 | gacagcaggacttacaaaca | SEQ ID NO: 2020 |
| >gRNA1140 | acagcaggacttacaaacaa | SEQ ID NO: 2021 |
| >gRNA1141 | acaaaggcctataccttctt | SEQ ID NO: 2022 |
| >gRNA1142 | accttcttgagatgttcgtt | SEQ ID NO: 2023 |
| >gRNA1143 | ttcagtgctaaatatacctg | SEQ ID NO: 2024 |
| >gRNA1144 | tatacctgaagctgccacaa | SEQ ID NO: 2025 |
| >gRNA1145 | cctgaagctgccacaaaagc | SEQ ID NO: 2026 |
| >gRNA1146 | tgaagctgccacaaaagcta | SEQ ID NO: 2027 |
| >gRNA1147 | gaagctgccacaaaagctag | SEQ ID NO: 2028 |

FIG. 3 cont.

| | | |
|---|---|---|
| >gRNA1148 | gctgccacaaaagctagagg | SEQ ID NO: 2029 |
| >gRNA1149 | ccacaaaagctagaggaagc | SEQ ID NO: 2030 |
| >gRNA1150 | caaaagctagaggaagccag | SEQ ID NO: 2031 |
| >gRNA1151 | aaaagctagaggaagccagt | SEQ ID NO: 2032 |
| >gRNA1152 | gctagaggaagccagtaggt | SEQ ID NO: 2033 |
| >gRNA1153 | agaggaagccagtaggtaag | SEQ ID NO: 2034 |
| >gRNA1154 | gccagtaggtaagaagtgtt | SEQ ID NO: 2035 |
| >gRNA1155 | cagtaggtaagaagtgttaa | SEQ ID NO: 2036 |
| >gRNA1156 | gagtgtatatgtatttgtgc | SEQ ID NO: 2037 |
| >gRNA1157 | tgctgctccctgctcaactg | SEQ ID NO: 2038 |
| >gRNA1158 | gctgctccctgctcaactgc | SEQ ID NO: 2039 |
| >gRNA1159 | ctgctccctgctcaactgca | SEQ ID NO: 2040 |
| >gRNA1160 | ctcaactgcagggaaactac | SEQ ID NO: 2041 |
| >gRNA1161 | ctgcagggaaactactggtt | SEQ ID NO: 2042 |
| >gRNA1162 | tcagaaccatgctgtgcat | SEQ ID NO: 2043 |
| >gRNA1163 | catgctgtgcatcagtatct | SEQ ID NO: 2044 |
| >gRNA1164 | gctgtgcatcagtatctcag | SEQ ID NO: 2045 |
| >gRNA1165 | ctgtgcatcagtatctcagc | SEQ ID NO: 2046 |
| >gRNA1166 | gtgccactaatctgatcttt | SEQ ID NO: 2047 |
| >gRNA1167 | tccctgacaatcccaatatg | SEQ ID NO: 2048 |
| >gRNA1168 | aatatgcagattgtttatat | SEQ ID NO: 2049 |
| >gRNA1169 | tgcagattgtttatatcaga | SEQ ID NO: 2050 |
| >gRNA1170 | gcagattgtttatatcagat | SEQ ID NO: 2051 |
| >gRNA1171 | attgtttatatcagatggga | SEQ ID NO: 2052 |
| >gRNA1172 | ttgtttatatcagatgggat | SEQ ID NO: 2053 |
| >gRNA1173 | cagatgggatgggactcatt | SEQ ID NO: 2054 |
| >gRNA1174 | agatgggatgggactcattc | SEQ ID NO: 2055 |
| >gRNA1175 | gatgggatgggactcattca | SEQ ID NO: 2056 |
| >gRNA1176 | gggatgggactcattcaggg | SEQ ID NO: 2057 |
| >gRNA1177 | gggactcattcagggtagta | SEQ ID NO: 2058 |
| >gRNA1178 | cattcagggtagtatggcca | SEQ ID NO: 2059 |
| >gRNA1179 | catagacctttttatatca | SEQ ID NO: 2060 |
| >gRNA1180 | agacctttttatatcaaag | SEQ ID NO: 2061 |
| >gRNA1181 | gactactcatacacaacttt | SEQ ID NO: 2062 |
| >gRNA1182 | tactcatacacaactttcag | SEQ ID NO: 2063 |
| >gRNA1183 | caactttcagcagcttacaa | SEQ ID NO: 2064 |
| >gRNA1184 | agcagcttacaaaagaatgt | SEQ ID NO: 2065 |
| >gRNA1185 | cttaccccacttaactatct | SEQ ID NO: 2066 |
| >gRNA1186 | ttaccccacttaactatctt | SEQ ID NO: 2067 |
| >gRNA1187 | aactatcttgggctgtgaca | SEQ ID NO: 2068 |
| >gRNA1188 | tgggctgtgacaaaagtcaca | SEQ ID NO: 2069 |

FIG. 3 cont.

| | | |
|---|---|---|
| >gRNA1189 | acaaagtcacatggttcaca | SEQ ID NO: 2070 |
| >gRNA1190 | aagtcacatggttcacacgg | SEQ ID NO: 2071 |
| >gRNA1191 | agtcacatggttcacacggc | SEQ ID NO: 2072 |
| >gRNA1192 | gcaggcatactcatctttt | SEQ ID NO: 2073 |
| >gRNA1193 | ggcatactcatcttttcag | SEQ ID NO: 2074 |
| >gRNA1194 | gcatactcatcttttcagt | SEQ ID NO: 2075 |
| >gRNA1195 | catactcatcttttcagtg | SEQ ID NO: 2076 |
| >gRNA1196 | atactcatcttttcagtgg | SEQ ID NO: 2077 |
| >gRNA1197 | tttttcagtgggggtgaatt | SEQ ID NO: 2078 |
| >gRNA1198 | cagtgggggtgaattcagtg | SEQ ID NO: 2079 |
| >gRNA1199 | gggtgaattcagtgtagtac | SEQ ID NO: 2080 |
| >gRNA1200 | gtgaattcagtgtagtacaa | SEQ ID NO: 2081 |
| >gRNA1201 | attcagtgtagtacaagaga | SEQ ID NO: 2082 |
| >gRNA1202 | agtgtagtacaagagataga | SEQ ID NO: 2083 |
| >gRNA1203 | agtacaagagatagaaagac | SEQ ID NO: 2084 |
| >gRNA1204 | gaaagaccagtccttgctga | SEQ ID NO: 2085 |
| >gRNA1205 | accagtccttgctgaaagac | SEQ ID NO: 2086 |
| >gRNA1206 | tcaattctctctccattctt | SEQ ID NO: 2087 |
| >gRNA1207 | ttctctctccattcttcagt | SEQ ID NO: 2088 |
| >gRNA1208 | cagtaagtcaacttcaatgt | SEQ ID NO: 2089 |
| >gRNA1209 | aagtcaacttcaatgtcgga | SEQ ID NO: 2090 |
| >gRNA1210 | aatgtcggatggatgaaacc | SEQ ID NO: 2091 |
| >gRNA1211 | atggatgaaacccagacaca | SEQ ID NO: 2092 |
| >gRNA1212 | aacccagacacatagcaatt | SEQ ID NO: 2093 |
| >gRNA1213 | acccagacacatagcaattc | SEQ ID NO: 2094 |
| >gRNA1214 | tttgactttccattctctgc | SEQ ID NO: 2095 |
| >gRNA1215 | cattctctgctggatgacgt | SEQ ID NO: 2096 |
| >gRNA1216 | cgtgagtaaacctgaatctt | SEQ ID NO: 2097 |
| >gRNA1217 | tgagtaaacctgaatctttg | SEQ ID NO: 2098 |
| >gRNA1218 | cctgaatctttggagtacct | SEQ ID NO: 2099 |
| >gRNA1219 | ctgaatctttggagtacctg | SEQ ID NO: 2100 |
| >gRNA1220 | ttggagtacctgaggaatat | SEQ ID NO: 2101 |
| >gRNA1221 | tggagtacctgaggaatatc | SEQ ID NO: 2102 |
| >gRNA1222 | tacctgaggaatatcgggaa | SEQ ID NO: 2103 |
| >gRNA1223 | aaaagacacattaatattgc | SEQ ID NO: 2104 |
| >gRNA1224 | aaagacacattaatattgcc | SEQ ID NO: 2105 |
| >gRNA1225 | aagacacattaatattgcca | SEQ ID NO: 2106 |
| >gRNA1226 | tattgccagggtatttcact | SEQ ID NO: 2107 |
| >gRNA1227 | attgccagggtatttcactt | SEQ ID NO: 2108 |
| >gRNA1228 | ttgccagggtatttcacttg | SEQ ID NO: 2109 |
| >gRNA1229 | tatttcacttgggggctaact | SEQ ID NO: 2110 |

FIG. 3 cont.

| | | |
|---|---|---|
| >gRNA1230 | cttggggctaacttggtgtc | SEQ ID NO: 2111 |
| >gRNA1231 | aacttggtgtcaagctatat | SEQ ID NO: 2112 |
| >gRNA1232 | acttggtgtcaagctatatc | SEQ ID NO: 2113 |
| >gRNA1233 | gtcaagctatatcaggcacc | SEQ ID NO: 2114 |
| >gRNA1234 | aggcaccaagtgtttacatt | SEQ ID NO: 2115 |
| >gRNA1235 | tcccaattccatttccactc | SEQ ID NO: 2116 |
| >gRNA1236 | catttccactctggccaaat | SEQ ID NO: 2117 |
| >gRNA1237 | tgagcttccaccttcccaac | SEQ ID NO: 2118 |
| >gRNA1238 | aacaagccacctccattttg | SEQ ID NO: 2119 |
| >gRNA1239 | ttgaagaataaaccgtgact | SEQ ID NO: 2120 |
| >gRNA1240 | tgccttttttgtttttttc | SEQ ID NO: 2121 |
| >gRNA1241 | cttttttgtttttttctag | SEQ ID NO: 2122 |
| >gRNA1242 | ttttttttctagcagatttc | SEQ ID NO: 2123 |
| >gRNA1243 | tttttctagcagatttctag | SEQ ID NO: 2124 |
| >gRNA1244 | ctagcagtatcttctgtcac | SEQ ID NO: 2125 |
| >gRNA1245 | agcagtatcttctgtcactg | SEQ ID NO: 2126 |
| >gRNA1246 | ggagattgcgctgcattttt | SEQ ID NO: 2127 |
| >gRNA1247 | agattgcgctgcattttaa | SEQ ID NO: 2128 |
| >gRNA1248 | cattttaagagcctttctc | SEQ ID NO: 2129 |
| >gRNA1249 | tttttaagagcctttctctg | SEQ ID NO: 2130 |
| >gRNA1250 | ttttaagagcctttctctgg | SEQ ID NO: 2131 |
| >gRNA1251 | gcctttctctggaggctctc | SEQ ID NO: 2132 |
| >gRNA1252 | cctttctctggaggctctca | SEQ ID NO: 2133 |
| >gRNA1253 | aaggacttctgatgccctct | SEQ ID NO: 2134 |
| >gRNA1254 | tgatgccctctcagcactca | SEQ ID NO: 2135 |
| >gRNA1255 | cattccttaacacatcactc | SEQ ID NO: 2136 |
| >gRNA1256 | ttccttaacacatcactcaa | SEQ ID NO: 2137 |
| >gRNA1257 | actcaagagtctacatgatt | SEQ ID NO: 2138 |
| >gRNA1258 | agtctacatgatttggcccc | SEQ ID NO: 2139 |
| >gRNA1259 | tggccccaagatacttttca | SEQ ID NO: 2140 |
| >gRNA1260 | acttttcaaagttcatttct | SEQ ID NO: 2141 |
| >gRNA1261 | gttcatttctcagttcataa | SEQ ID NO: 2142 |
| >gRNA1262 | tatgtttatgcctttcttt | SEQ ID NO: 2143 |
| >gRNA1263 | ctgattttctaaactgtatg | SEQ ID NO: 2144 |
| >gRNA1264 | tctaaactgtatgaagtgtc | SEQ ID NO: 2145 |
| >gRNA1265 | aaactgtatgaagtgtctag | SEQ ID NO: 2146 |
| >gRNA1266 | actgtatgaagtgtctagta | SEQ ID NO: 2147 |
| >gRNA1267 | gaagtgtctagtagagtgcc | SEQ ID NO: 2148 |
| >gRNA1268 | aagtgtctagtagagtgcct | SEQ ID NO: 2149 |
| >gRNA1269 | ctagtagagtgcctgggaca | SEQ ID NO: 2150 |
| >gRNA1270 | catagcaattgctctatacg | SEQ ID NO: 2151 |

FIG. 3 cont.

| | | |
|---|---|---|
| >gRNA1271 | agcaattgctctatacgtgg | SEQ ID NO: 2152 |
| >gRNA1272 | cgtggcagatgttattatct | SEQ ID NO: 2153 |
| >gRNA1273 | gtggcagatgttattatctg | SEQ ID NO: 2154 |
| >gRNA1274 | tgttattatctgaggttcct | SEQ ID NO: 2155 |
| >gRNA1275 | tattatctgaggttcctaag | SEQ ID NO: 2156 |
| >gRNA1276 | gttcctaagtggatcaaccc | SEQ ID NO: 2157 |
| >gRNA1277 | ttcctaagtggatcaaccca | SEQ ID NO: 2158 |
| >gRNA1278 | tttttattttttattttt | SEQ ID NO: 2159 |
| >gRNA1279 | ttttattttttattttt | SEQ ID NO: 2160 |
| >gRNA1280 | tatttttttattttttggga | SEQ ID NO: 2161 |
| >gRNA1281 | tggaatctcattccattgcc | SEQ ID NO: 2162 |
| >gRNA1282 | ggaatctcattccattgccc | SEQ ID NO: 2163 |
| >gRNA1283 | tctcattccattgcccaggc | SEQ ID NO: 2164 |
| >gRNA1284 | tcattccattgcccaggctg | SEQ ID NO: 2165 |
| >gRNA1285 | ccattgcccaggctggagtg | SEQ ID NO: 2166 |
| >gRNA1286 | ccaggctggagtgcagtgtg | SEQ ID NO: 2167 |
| >gRNA1287 | ggctggagtgcagtgtgcag | SEQ ID NO: 2168 |
| >gRNA1288 | ggagtgcagtgtgcagtggt | SEQ ID NO: 2169 |
| >gRNA1289 | agtgtgcagtggtgagatct | SEQ ID NO: 2170 |
| >gRNA1290 | tcactgcaacctccgcctcc | SEQ ID NO: 2171 |
| >gRNA1291 | cactgcaacctccgcctcct | SEQ ID NO: 2172 |
| >gRNA1292 | aacctccgcctcctgggttc | SEQ ID NO: 2173 |
| >gRNA1293 | tcctgggttcaagtgattcc | SEQ ID NO: 2174 |
| >gRNA1294 | cctgggttcaagtgattcct | SEQ ID NO: 2175 |
| >gRNA1295 | tcaagtgattcctgggacta | SEQ ID NO: 2176 |
| >gRNA1296 | caagtgattcctgggactac | SEQ ID NO: 2177 |
| >gRNA1297 | caggcacacaccaccatgcc | SEQ ID NO: 2178 |
| >gRNA1298 | ctggttaattttgtatttt | SEQ ID NO: 2179 |
| >gRNA1299 | gttaattttgtattttcag | SEQ ID NO: 2180 |
| >gRNA1300 | taattttgtattttcagta | SEQ ID NO: 2181 |
| >gRNA1301 | ttttgtattttcagtagaga | SEQ ID NO: 2182 |
| >gRNA1302 | tttgtattttcagtagagac | SEQ ID NO: 2183 |
| >gRNA1303 | gagacgggatttcaccatgt | SEQ ID NO: 2184 |
| >gRNA1304 | cgggatttcaccatgttggc | SEQ ID NO: 2185 |
| >gRNA1305 | gggatttcaccatgttggcc | SEQ ID NO: 2186 |
| >gRNA1306 | tttcaccatgttggccaggc | SEQ ID NO: 2187 |
| >gRNA1307 | ggtcttgaactcccaacttc | SEQ ID NO: 2188 |
| >gRNA1308 | aactcccaacttcaagtgat | SEQ ID NO: 2189 |
| >gRNA1309 | ttcaagtgatcagcctgcct | SEQ ID NO: 2190 |
| >gRNA1310 | cagcctgccttggcctccca | SEQ ID NO: 2191 |
| >gRNA1311 | gccttggcctcccaaaagtgt | SEQ ID NO: 2192 |

FIG. 3 cont.

| | | |
|---|---|---|
| >gRNA1312 | ccttggcctcccaaagtgtt | SEQ ID NO: 2193 |
| >gRNA1313 | ctcccaaagtgttgggatta | SEQ ID NO: 2194 |
| >gRNA1314 | tcccaaagtgttgggattac | SEQ ID NO: 2195 |
| >gRNA1315 | agtgttgggattacaggcac | SEQ ID NO: 2196 |
| >gRNA1316 | ccaccgtgcccaaccaaccc | SEQ ID NO: 2197 |
| >gRNA1317 | caccgtgcccaaccaaccca | SEQ ID NO: 2198 |
| >gRNA1318 | aaaacctctttatttctgct | SEQ ID NO: 2199 |
| >gRNA1319 | aaacctctttatttctgctg | SEQ ID NO: 2200 |
| >gRNA1320 | tctgctgaggttttatatgc | SEQ ID NO: 2201 |
| >gRNA1321 | gactttgtacctaatttcat | SEQ ID NO: 2202 |
| >gRNA1322 | atttcatgagctaaaaaaca | SEQ ID NO: 2203 |
| >gRNA1323 | aacaaaacctaaatgcatac | SEQ ID NO: 2204 |
| >gRNA1324 | caaaacctaaatgcatacaa | SEQ ID NO: 2205 |
| >gRNA1325 | acctaaatgcatacaagagc | SEQ ID NO: 2206 |
| >gRNA1326 | gagctggcaaataccttaaa | SEQ ID NO: 2207 |
| >gRNA1327 | ggcaaataccttaaatggtt | SEQ ID NO: 2208 |
| >gRNA1328 | aataccttaaatggttgagt | SEQ ID NO: 2209 |
| >gRNA1329 | ttggacccgataaaatacaa | SEQ ID NO: 2210 |
| >gRNA1330 | tggacccgataaaatacaac | SEQ ID NO: 2211 |
| >gRNA1331 | ggacccgataaaatacaaca | SEQ ID NO: 2212 |
| >gRNA1332 | ccgataaaatacaacaggga | SEQ ID NO: 2213 |
| >gRNA1333 | cgataaaatacaacagggat | SEQ ID NO: 2214 |
| >gRNA1334 | aaaatacaacagggataggt | SEQ ID NO: 2215 |
| >gRNA1335 | aaatacaacagggataggtg | SEQ ID NO: 2216 |
| >gRNA1336 | acagggataggtgaggacta | SEQ ID NO: 2217 |
| >gRNA1337 | taggtgaggactatggcaaa | SEQ ID NO: 2218 |
| >gRNA1338 | aggtgaggactatggcaaat | SEQ ID NO: 2219 |
| >gRNA1339 | gaggactatggcaaatggga | SEQ ID NO: 2220 |
| >gRNA1340 | tactttccattatgatcaaa | SEQ ID NO: 2221 |
| >gRNA1341 | ctttccattatgatcaaatg | SEQ ID NO: 2222 |
| >gRNA1342 | aaatggagtaatgcatgtga | SEQ ID NO: 2223 |
| >gRNA1343 | tggagtaatgcatgtgacag | SEQ ID NO: 2224 |
| >gRNA1344 | ggagtaatgcatgtgacagt | SEQ ID NO: 2225 |
| >gRNA1345 | agtgggatttgcgttttaat | SEQ ID NO: 2226 |
| >gRNA1346 | tgcgttttaattagcatcca | SEQ ID NO: 2227 |
| >gRNA1347 | gcgttttaattagcatccac | SEQ ID NO: 2228 |
| >gRNA1348 | cacaggtgattgctgtaaac | SEQ ID NO: 2229 |
| >gRNA1349 | ggtgattgctgtaaactagc | SEQ ID NO: 2230 |
| >gRNA1350 | gtgattgctgtaaactagcc | SEQ ID NO: 2231 |
| >gRNA1351 | ttgctgtaaactagccaggt | SEQ ID NO: 2232 |
| >gRNA1352 | tgctgtaaactagccaggtt | SEQ ID NO: 2233 |

FIG. 3 cont.

| | | |
|---|---|---|
| >gRNA1353 | gaatatattgcctaatgttt | SEQ ID NO: 2234 |
| >gRNA1354 | attgcctaatgtttcagaaa | SEQ ID NO: 2235 |
| >gRNA1355 | gaaacagtactttccaaaat | SEQ ID NO: 2236 |
| >gRNA1356 | aacagtactttccaaaatga | SEQ ID NO: 2237 |
| >gRNA1357 | acagtactttccaaaatgag | SEQ ID NO: 2238 |
| >gRNA1358 | tccaaaatgagaggcatgac | SEQ ID NO: 2239 |
| >gRNA1359 | aggcatgactagaccatcca | SEQ ID NO: 2240 |
| >gRNA1360 | ggcatgactagaccatccat | SEQ ID NO: 2241 |
| >gRNA1361 | gcatgactagaccatccatg | SEQ ID NO: 2242 |
| >gRNA1362 | tgactagaccatccatgggg | SEQ ID NO: 2243 |
| >gRNA1363 | ctagaccatccatggggaag | SEQ ID NO: 2244 |
| >gRNA1364 | tagaccatccatggggaagt | SEQ ID NO: 2245 |
| >gRNA1365 | accatccatggggaagtggg | SEQ ID NO: 2246 |
| >gRNA1366 | tatattttcattgaaaatg | SEQ ID NO: 2247 |
| >gRNA1367 | tattttcattgaaaatgaa | SEQ ID NO: 2248 |
| >gRNA1368 | ttttcattgaaaatgaagag | SEQ ID NO: 2249 |
| >gRNA1369 | ttgaaaatgaagagaagtgt | SEQ ID NO: 2250 |
| >gRNA1370 | tgttagtgctactaaatata | SEQ ID NO: 2251 |
| >gRNA1371 | cttttaaatacacttatatt | SEQ ID NO: 2252 |
| >gRNA1372 | ttttaaatacacttatattc | SEQ ID NO: 2253 |
| >gRNA1373 | tttaaatacacttatattca | SEQ ID NO: 2254 |
| >gRNA1374 | tcagggtacatgatcactaa | SEQ ID NO: 2255 |
| >gRNA1375 | cagggtacatgatcactaaa | SEQ ID NO: 2256 |
| >gRNA1376 | ggtacatgatcactaaaagg | SEQ ID NO: 2257 |
| >gRNA1377 | ggcagctactcctccttgtc | SEQ ID NO: 2258 |
| >gRNA1378 | gcagctactcctccttgtct | SEQ ID NO: 2259 |
| >gRNA1379 | agctactcctccttgtctgg | SEQ ID NO: 2260 |
| >gRNA1380 | gctactcctccttgtctggg | SEQ ID NO: 2261 |
| >gRNA1381 | cctccttgtctgggaggctg | SEQ ID NO: 2262 |
| >gRNA1382 | ctccttgtctgggaggctgt | SEQ ID NO: 2263 |
| >gRNA1383 | tccttgtctgggaggctgtg | SEQ ID NO: 2264 |
| >gRNA1384 | cttgtctgggaggctgtggg | SEQ ID NO: 2265 |
| >gRNA1385 | gtctgggaggctgtggggag | SEQ ID NO: 2266 |
| >gRNA1386 | tctgggaggctgtggggaga | SEQ ID NO: 2267 |
| >gRNA1387 | tgggaggctgtggggagaag | SEQ ID NO: 2268 |
| >gRNA1388 | gggaggctgtggggagaagg | SEQ ID NO: 2269 |
| >gRNA1389 | gaggctgtggggagaaggag | SEQ ID NO: 2270 |
| >gRNA1390 | gtggggagaaggaggagtac | SEQ ID NO: 2271 |
| >gRNA1391 | tggggagaaggaggagtacc | SEQ ID NO: 2272 |
| >gRNA1392 | gagtaccaggccaccttgac | SEQ ID NO: 2273 |
| >gRNA1393 | cttgaccagatatatctctc | SEQ ID NO: 2274 |

FIG. 3 cont.

| | | |
|---|---|---|
| >gRNA1394 | tctagaaacaccctatcatt | SEQ ID NO: 2275 |
| >gRNA1395 | ctagaaacaccctatcatta | SEQ ID NO: 2276 |
| >gRNA1396 | aaacaccctatcattaagga | SEQ ID NO: 2277 |
| >gRNA1397 | aacaccctatcattaaggaa | SEQ ID NO: 2278 |
| >gRNA1398 | tatcattaaggaaaggctac | SEQ ID NO: 2279 |
| >gRNA1399 | gaaaggctactagccccatc | SEQ ID NO: 2280 |
| >gRNA1400 | aaggctactagccccatcaa | SEQ ID NO: 2281 |
| >gRNA1401 | aggctactagccccatcaag | SEQ ID NO: 2282 |
| >gRNA1402 | ctactagccccatcaagagg | SEQ ID NO: 2283 |
| >gRNA1403 | agccccatcaagaggtggat | SEQ ID NO: 2284 |
| >gRNA1404 | gccccatcaagaggtggatt | SEQ ID NO: 2285 |
| >gRNA1405 | ccccatcaagaggtggattg | SEQ ID NO: 2286 |
| >gRNA1406 | gtggattggggaatctaatg | SEQ ID NO: 2287 |
| >gRNA1407 | gattttttcataacattaa | SEQ ID NO: 2288 |
| >gRNA1408 | ttttcataacattaaaagct | SEQ ID NO: 2289 |
| >gRNA1409 | ttcataacattaaaagctaa | SEQ ID NO: 2290 |
| >gRNA1410 | cataacattaaaagctaaga | SEQ ID NO: 2291 |
| >gRNA1411 | taagagagctctttgcatct | SEQ ID NO: 2292 |
| >gRNA1412 | gcatctgagcttctaataat | SEQ ID NO: 2293 |
| >gRNA1413 | taagaacatattaaatgcct | SEQ ID NO: 2294 |
| >gRNA1414 | aagaacatattaaatgcctc | SEQ ID NO: 2295 |
| >gRNA1415 | agaacatattaaatgcctca | SEQ ID NO: 2296 |
| >gRNA1416 | atattaaatgcctcagggat | SEQ ID NO: 2297 |
| >gRNA1417 | attaaatgcctcagggatca | SEQ ID NO: 2298 |
| >gRNA1418 | atgcctcagggatcagagca | SEQ ID NO: 2299 |
| >gRNA1419 | gagcacagattcatcctgcc | SEQ ID NO: 2300 |
| >gRNA1420 | ctgcctggaactctctgttt | SEQ ID NO: 2301 |
| >gRNA1421 | tgcctggaactctctgtttg | SEQ ID NO: 2302 |
| >gRNA1422 | gcctggaactctctgtttga | SEQ ID NO: 2303 |
| >gRNA1423 | tggaactctctgtttgaggg | SEQ ID NO: 2304 |
| >gRNA1424 | ggaactctctgtttgaggga | SEQ ID NO: 2305 |
| >gRNA1425 | actctctgtttgagggaagg | SEQ ID NO: 2306 |
| >gRNA1426 | tctgtttgagggaaggcggc | SEQ ID NO: 2307 |
| >gRNA1427 | ggaaggcggcaagattttgt | SEQ ID NO: 2308 |
| >gRNA1428 | aaggcggcaagattttgtga | SEQ ID NO: 2309 |
| >gRNA1429 | gcatcactgtaatctttct | SEQ ID NO: 2310 |
| >gRNA1430 | tcactgtaatcttttctaag | SEQ ID NO: 2311 |
| >gRNA1431 | actgtaatcttttctaagaa | SEQ ID NO: 2312 |
| >gRNA1432 | ctgtaatcttttctaagaag | SEQ ID NO: 2313 |
| >gRNA1433 | atcttttctaagaagaggac | SEQ ID NO: 2314 |
| >gRNA1434 | tctaagaagaggacaagtat | SEQ ID NO: 2315 |

FIG. 3 cont.

| | | |
|---|---|---|
| >gRNA1435 | agaagaggacaagtatcaga | SEQ ID NO: 2316 |
| >gRNA1436 | gaagaggacaagtatcagac | SEQ ID NO: 2317 |
| >gRNA1437 | aggacaagtatcagacaggc | SEQ ID NO: 2318 |
| >gRNA1438 | ggacaagtatcagacaggct | SEQ ID NO: 2319 |
| >gRNA1439 | agacaggctgggtttgaatt | SEQ ID NO: 2320 |
| >gRNA1440 | gacaggctgggtttgaattt | SEQ ID NO: 2321 |
| >gRNA1441 | ggtttgaatttgggctcaac | SEQ ID NO: 2322 |
| >gRNA1442 | atttgggctcaaccagttac | SEQ ID NO: 2323 |
| >gRNA1443 | gttactggctttatgacttt | SEQ ID NO: 2324 |
| >gRNA1444 | tactggctttatgactttttg | SEQ ID NO: 2325 |
| >gRNA1445 | ctggctttatgacttttgga | SEQ ID NO: 2326 |
| >gRNA1446 | tgacttttggagagttattt | SEQ ID NO: 2327 |
| >gRNA1447 | gaaaaattaatttatgccca | SEQ ID NO: 2328 |
| >gRNA1448 | acaaaaacaaaacccacaca | SEQ ID NO: 2329 |
| >gRNA1449 | caaaaacaaaacccacacac | SEQ ID NO: 2330 |
| >gRNA1450 | aacaaaacccacacacaggt | SEQ ID NO: 2331 |
| >gRNA1451 | caaaacccacacacaggtca | SEQ ID NO: 2332 |
| >gRNA1452 | aaaacccacacacaggtcag | SEQ ID NO: 2333 |
| >gRNA1453 | aacccacacacaggtcagag | SEQ ID NO: 2334 |
| >gRNA1454 | acccacacacaggtcagagg | SEQ ID NO: 2335 |
| >gRNA1455 | cacaggtcagaggaggaaaa | SEQ ID NO: 2336 |
| >gRNA1456 | agaggaggaaaatagacctt | SEQ ID NO: 2337 |
| >gRNA1457 | aggaggaaaatagaccttca | SEQ ID NO: 2338 |
| >gRNA1458 | ggaggaaaatagaccttcag | SEQ ID NO: 2339 |
| >gRNA1459 | tcatcattacatgtttcttg | SEQ ID NO: 2340 |
| >gRNA1460 | atgtttcttgtggtatcttc | SEQ ID NO: 2341 |
| >gRNA1461 | cttgtggtatcttccagaaa | SEQ ID NO: 2342 |
| >gRNA1462 | ttccagaaatggtctatgca | SEQ ID NO: 2343 |
| >gRNA1463 | atgcatggcatgtattactt | SEQ ID NO: 2344 |
| >gRNA1464 | actttggaaattttcaaaat | SEQ ID NO: 2345 |
| >gRNA1465 | taagatttttttttaaatat | SEQ ID NO: 2346 |
| >gRNA1466 | aaaatgacatctaacataac | SEQ ID NO: 2347 |
| >gRNA1467 | ctaacataaccagcaaatac | SEQ ID NO: 2348 |
| >gRNA1468 | taaccagcaaataccagtaa | SEQ ID NO: 2349 |
| >gRNA1469 | ccagcaaataccagtaatgg | SEQ ID NO: 2350 |
| >gRNA1470 | tgctttcgatcatgttttgc | SEQ ID NO: 2351 |
| >gRNA1471 | ctttcgatcatgttttgcca | SEQ ID NO: 2352 |
| >gRNA1472 | tttcgatcatgttttgccag | SEQ ID NO: 2353 |
| >gRNA1473 | atcatgttttgccagaggaa | SEQ ID NO: 2354 |
| >gRNA1474 | tcatgttttgccagaggaaa | SEQ ID NO: 2355 |
| >gRNA1475 | gttttgccagaggaaaaggt | SEQ ID NO: 2356 |

FIG. 3 cont.

| | | |
|---|---|---|
| >gRNA1476 | gaggaaaaggtgagcgcgct | SEQ ID NO: 2357 |
| >gRNA1477 | gagcgcgcttagtgtattgc | SEQ ID NO: 2358 |
| >gRNA1478 | agcgcgcttagtgtattgcc | SEQ ID NO: 2359 |
| >gRNA1479 | ttagtgtattgccaggtact | SEQ ID NO: 2360 |
| >gRNA1480 | tgtattgccaggtacttaga | SEQ ID NO: 2361 |
| >gRNA1481 | caggtacttagaaagtgctc | SEQ ID NO: 2362 |
| >gRNA1482 | tagaaagtgctcaagatctc | SEQ ID NO: 2363 |
| >gRNA1483 | aagatctctggcgtcctcaa | SEQ ID NO: 2364 |
| >gRNA1484 | tctggcgtcctcaacagtct | SEQ ID NO: 2365 |
| >gRNA1485 | aacagtcttggtaaccatct | SEQ ID NO: 2366 |
| >gRNA1486 | tcttggattatctttattaa | SEQ ID NO: 2367 |
| >gRNA1487 | tatctttattaatggtttta | SEQ ID NO: 2368 |
| >gRNA1488 | tttttttttttttctttttt | SEQ ID NO: 2369 |
| >gRNA1489 | ttttttttttttcttttttga | SEQ ID NO: 2370 |
| >gRNA1490 | ttttttctttttttgagaga | SEQ ID NO: 2371 |
| >gRNA1491 | tttttctttttttgagagac | SEQ ID NO: 2372 |
| >gRNA1492 | ttttctttttgagagaca | SEQ ID NO: 2373 |
| >gRNA1493 | tctcgctctgttgcccacgc | SEQ ID NO: 2374 |
| >gRNA1494 | tcgctctgttgcccacgctg | SEQ ID NO: 2375 |
| >gRNA1495 | ttgcccacgctggagtgcac | SEQ ID NO: 2376 |
| >gRNA1496 | ggagtgcactggcgccatga | SEQ ID NO: 2377 |
| >gRNA1497 | ctggcgccatgatagctcaa | SEQ ID NO: 2378 |
| >gRNA1498 | ccatgatagctcaaaagcct | SEQ ID NO: 2379 |
| >gRNA1499 | tagctcaaaagcctaagctc | SEQ ID NO: 2380 |
| >gRNA1500 | gctcaaaagcctaagctcaa | SEQ ID NO: 2381 |
| >gRNA1501 | ctcaagagatcctcccgcct | SEQ ID NO: 2382 |
| >gRNA1502 | gatcctcccgcctcagccac | SEQ ID NO: 2383 |
| >gRNA1503 | tcctcccgcctcagccaccg | SEQ ID NO: 2384 |
| >gRNA1504 | tcccgcctcagccaccggag | SEQ ID NO: 2385 |
| >gRNA1505 | gcctcagccaccggagcagc | SEQ ID NO: 2386 |
| >gRNA1506 | cctcagccaccggagcagct | SEQ ID NO: 2387 |
| >gRNA1507 | caccggagcagctgggacca | SEQ ID NO: 2388 |
| >gRNA1508 | accggagcagctgggaccac | SEQ ID NO: 2389 |
| >gRNA1509 | gcagctgggaccacaggcac | SEQ ID NO: 2390 |
| >gRNA1510 | caggcacgagccaccacacc | SEQ ID NO: 2391 |
| >gRNA1511 | attttgttattattttttg | SEQ ID NO: 2392 |
| >gRNA1512 | ttttgttattattttttgta | SEQ ID NO: 2393 |
| >gRNA1513 | ttattattttttgtagagac | SEQ ID NO: 2394 |
| >gRNA1514 | tattatttttttgtagagacc | SEQ ID NO: 2395 |
| >gRNA1515 | gagaccaggcttcaccatgt | SEQ ID NO: 2396 |
| >gRNA1516 | ccaggcttcaccatgttggc | SEQ ID NO: 2397 |

FIG. 3 cont.

| | | |
|---|---|---|
| >gRNA1517 | caggcttcaccatgttggcc | SEQ ID NO: 2398 |
| >gRNA1518 | cttcaccatgttggccaggc | SEQ ID NO: 2399 |
| >gRNA1519 | ggccaggctggtctcaacta | SEQ ID NO: 2400 |
| >gRNA1520 | tggtctcaactacggacctc | SEQ ID NO: 2401 |
| >gRNA1521 | ctcaagccatcctcccgcct | SEQ ID NO: 2402 |
| >gRNA1522 | cctcccgcctcggcctccct | SEQ ID NO: 2403 |
| >gRNA1523 | gcctcggcctccctaagtgc | SEQ ID NO: 2404 |
| >gRNA1524 | cctcggcctccctaagtgct | SEQ ID NO: 2405 |
| >gRNA1525 | ctccctaagtgctgggatta | SEQ ID NO: 2406 |
| >gRNA1526 | tccctaagtgctgggattac | SEQ ID NO: 2407 |
| >gRNA1527 | agtgctgggattacaggcgt | SEQ ID NO: 2408 |
| >gRNA1528 | cctcatgttttcaaaaccga | SEQ ID NO: 2409 |
| >gRNA1529 | atgttttcaaaaccgaaagt | SEQ ID NO: 2410 |
| >gRNA1530 | gttttcaaaaccgaaagtaa | SEQ ID NO: 2411 |
| >gRNA1531 | ttttcaaaaccgaaagtaag | SEQ ID NO: 2412 |
| >gRNA1532 | aaaaccgaaagtaagaggca | SEQ ID NO: 2413 |
| >gRNA1533 | gtaagaggcacagtacatct | SEQ ID NO: 2414 |
| >gRNA1534 | cagtacatcttggaaacaac | SEQ ID NO: 2415 |
| >gRNA1535 | agtacatcttggaaacaacc | SEQ ID NO: 2416 |
| >gRNA1536 | atcttggaaacaaccaggca | SEQ ID NO: 2417 |
| >gRNA1537 | cttggaaacaaccaggcaaa | SEQ ID NO: 2418 |
| >gRNA1538 | aacaaccaggcaaagagcca | SEQ ID NO: 2419 |
| >gRNA1539 | caaccaggcaaagagccaaa | SEQ ID NO: 2420 |
| >gRNA1540 | aaccaggcaaagagccaaag | SEQ ID NO: 2421 |
| >gRNA1541 | caggcaaagagccaaagagg | SEQ ID NO: 2422 |
| >gRNA1542 | gaggaagccctctgtacgaa | SEQ ID NO: 2423 |
| >gRNA1543 | ccctctgtacgaaaagacca | SEQ ID NO: 2424 |
| >gRNA1544 | cctctgtacgaaaagaccac | SEQ ID NO: 2425 |
| >gRNA1545 | ctctgtacgaaaagaccaca | SEQ ID NO: 2426 |
| >gRNA1546 | accacagggcccatgccgcc | SEQ ID NO: 2427 |
| >gRNA1547 | ccatgccgcccagtttgctc | SEQ ID NO: 2428 |
| >gRNA1548 | atgccgcccagtttgctctg | SEQ ID NO: 2429 |
| >gRNA1549 | ttgctctggagaatctcacg | SEQ ID NO: 2430 |
| >gRNA1550 | ctctggagaatctcacgcag | SEQ ID NO: 2431 |
| >gRNA1551 | tctggagaatctcacgcaga | SEQ ID NO: 2432 |
| >gRNA1552 | ggagaatctcacgcagaagg | SEQ ID NO: 2433 |
| >gRNA1553 | gagaatctcacgcagaaggc | SEQ ID NO: 2434 |
| >gRNA1554 | aaaaaaaaatgcacgaatta | SEQ ID NO: 2435 |
| >gRNA1555 | aatgcacgaattacagccaa | SEQ ID NO: 2436 |
| >gRNA1556 | atgcacgaattacagccaaa | SEQ ID NO: 2437 |
| >gRNA1557 | aaaggcatgcgctcccgcaa | SEQ ID NO: 2438 |

FIG. 3 cont.

| | | |
|---|---|---|
| >gRNA1558 | atgcgctcccgcaaaagccc | SEQ ID NO: 2439 |
| >gRNA1559 | gctcccgcaaaagccctggt | SEQ ID NO: 2440 |
| >gRNA1560 | ctcccgcaaaagccctggtt | SEQ ID NO: 2441 |
| >gRNA1561 | catttatccctgtgtaatt | SEQ ID NO: 2442 |
| >gRNA1562 | aattaagtttcttaaaatct | SEQ ID NO: 2443 |
| >gRNA1563 | ttcttaaaatctcggtgcct | SEQ ID NO: 2444 |
| >gRNA1564 | gccttagtttcttcatctgt | SEQ ID NO: 2445 |
| >gRNA1565 | cttagtttcttcatctgtga | SEQ ID NO: 2446 |
| >gRNA1566 | ttagtttcttcatctgtgag | SEQ ID NO: 2447 |
| >gRNA1567 | gtttcttcatctgtgagagg | SEQ ID NO: 2448 |
| >gRNA1568 | tcttcatctgtgagaggcag | SEQ ID NO: 2449 |
| >gRNA1569 | tgagaggcagaagataacca | SEQ ID NO: 2450 |
| >gRNA1570 | gaggcagaagataaccatag | SEQ ID NO: 2451 |
| >gRNA1571 | ataaccatagtagttatcta | SEQ ID NO: 2452 |
| >gRNA1572 | accatagtagttatctatgg | SEQ ID NO: 2453 |
| >gRNA1573 | atagtagttatctatggcgg | SEQ ID NO: 2454 |
| >gRNA1574 | ttttcaaaattaaatgacgca | SEQ ID NO: 2455 |
| >gRNA1575 | taaatgacgcaaagcacata | SEQ ID NO: 2456 |
| >gRNA1576 | cgcaaagcacataaagtcct | SEQ ID NO: 2457 |
| >gRNA1577 | cacataaagtccttggcaca | SEQ ID NO: 2458 |
| >gRNA1578 | taaagtccttggcacacaga | SEQ ID NO: 2459 |
| >gRNA1579 | acacagaaagatgtcaataa | SEQ ID NO: 2460 |
| >gRNA1580 | cacagaaagatgtcaataac | SEQ ID NO: 2461 |
| >gRNA1581 | agaaagatgtcaataacggg | SEQ ID NO: 2462 |
| >gRNA1582 | tagttcttataattttttaa | SEQ ID NO: 2463 |
| >gRNA1583 | tttttaaaagtgacatgtga | SEQ ID NO: 2464 |
| >gRNA1584 | ttttaaaagtgacatgtgat | SEQ ID NO: 2465 |
| >gRNA1585 | gacatgtgatgggaacaaat | SEQ ID NO: 2466 |
| >gRNA1586 | ttcgaaaccgctttgtatca | SEQ ID NO: 2467 |
| >gRNA1587 | aaccgctttgtatcacagcc | SEQ ID NO: 2468 |
| >gRNA1588 | cgcgtgctgtttcctcccca | SEQ ID NO: 2469 |
| >gRNA1589 | gctgtttcctccccacggtg | SEQ ID NO: 2470 |
| >gRNA1590 | ccccacggtgtggccccaca | SEQ ID NO: 2471 |
| >gRNA1591 | ggtgtggccccacatagacc | SEQ ID NO: 2472 |
| >gRNA1592 | tgtggccccacatagaccca | SEQ ID NO: 2473 |
| >gRNA1593 | gtggccccacatagacccag | SEQ ID NO: 2474 |
| >gRNA1594 | ccacatagacccagaggtgc | SEQ ID NO: 2475 |
| >gRNA1595 | cacatagacccagaggtgct | SEQ ID NO: 2476 |
| >gRNA1596 | ggtgctaggacatgcgaact | SEQ ID NO: 2477 |
| >gRNA1597 | gctaggacatgcgaacttag | SEQ ID NO: 2478 |
| >gRNA1598 | ctaggacatgcgaacttagc | SEQ ID NO: 2479 |

FIG. 3 cont.

| | | |
|---|---|---|
| >gRNA1599 | atgcgaacttagcgggcgcc | SEQ ID NO: 2480 |
| >gRNA1600 | acttagcgggcgcctagacg | SEQ ID NO: 2481 |
| >gRNA1601 | gggcgcctagacgaagtcca | SEQ ID NO: 2482 |
| >gRNA1602 | agacgaagtccacagctctc | SEQ ID NO: 2483 |
| >gRNA1603 | agtccacagctctccagtct | SEQ ID NO: 2484 |
| >gRNA1604 | gtccacagctctccagtcta | SEQ ID NO: 2485 |
| >gRNA1605 | tccacagctctccagtctaa | SEQ ID NO: 2486 |
| >gRNA1606 | acagctctccagtctaaggg | SEQ ID NO: 2487 |
| >gRNA1607 | gctctccagtctaagggaag | SEQ ID NO: 2488 |
| >gRNA1608 | tctccagtctaagggaagca | SEQ ID NO: 2489 |
| >gRNA1609 | gtctaagggaagcagagccg | SEQ ID NO: 2490 |
| >gRNA1610 | taagggaagcagagccgcag | SEQ ID NO: 2491 |
| >gRNA1611 | ggaagcagagccgcagcaga | SEQ ID NO: 2492 |
| >gRNA1612 | gaagcagagccgcagcagac | SEQ ID NO: 2493 |
| >gRNA1613 | ccgcagcagacaggcttacc | SEQ ID NO: 2494 |
| >gRNA1614 | cgcagcagacaggcttaccc | SEQ ID NO: 2495 |
| >gRNA1615 | tacccgggcgacgcctcccc | SEQ ID NO: 2496 |
| >gRNA1616 | cgacgcctccccagacccc | SEQ ID NO: 2497 |
| >gRNA1617 | ctccacgcgttcacaaacct | SEQ ID NO: 2498 |
| >gRNA1618 | aaacctcagcgccgcgcctt | SEQ ID NO: 2499 |
| >gRNA1619 | aacctcagcgccgcgccttt | SEQ ID NO: 2500 |
| >gRNA1620 | cagcgccgcgccttttgggac | SEQ ID NO: 2501 |
| >gRNA1621 | agcctacccgtcccccactc | SEQ ID NO: 2502 |
| >gRNA1622 | gtcccccactccagctgcgc | SEQ ID NO: 2503 |
| >gRNA1623 | tcccccactccagctgcgct | SEQ ID NO: 2504 |
| >gRNA1624 | cccccactccagctgcgctg | SEQ ID NO: 2505 |
| >gRNA1625 | ccccactccagctgcgctgg | SEQ ID NO: 2506 |
| >gRNA1626 | ccactccagctgcgctgggg | SEQ ID NO: 2507 |
| >gRNA1627 | tccagctgcgctggggggagc | SEQ ID NO: 2508 |
| >gRNA1628 | cagctgcgctgggggagcca | SEQ ID NO: 2509 |
| >gRNA1629 | agctgcgctgggggagccag | SEQ ID NO: 2510 |
| >gRNA1630 | gggagccagaggccccgcga | SEQ ID NO: 2511 |
| >gRNA1631 | gagccagaggccccgcgaaa | SEQ ID NO: 2512 |
| >gRNA1632 | ccagaggccccgcgaaagag | SEQ ID NO: 2513 |
| >gRNA1633 | gaggccccgcgaaagagcgg | SEQ ID NO: 2514 |
| >gRNA1634 | ggccccgcgaaagagcggaa | SEQ ID NO: 2515 |
| >gRNA1635 | gagaaaccctcccccaacct | SEQ ID NO: 2516 |
| >gRNA1636 | tcccgaccctcccgtcgccg | SEQ ID NO: 2517 |
| >gRNA1637 | cccgaccctcccgtcgccgt | SEQ ID NO: 2518 |
| >gRNA1638 | cctcccgtcgccgtaggcca | SEQ ID NO: 2519 |
| >gRNA1639 | ctcccgtcgccgtaggccaa | SEQ ID NO: 2520 |

FIG. 3 cont.

| | | |
|---|---|---|
| >gRNA1640 | tctcccctgctccccgccga | SEQ ID NO: 2521 |
| >gRNA1641 | ctccctgctccccgccgaa | SEQ ID NO: 2522 |
| >gRNA1642 | tccctgctccccgccgaaa | SEQ ID NO: 2523 |
| >gRNA1643 | cccctgctccccgccgaaag | SEQ ID NO: 2524 |
| >gRNA1644 | tgctccccgccgaaaggggc | SEQ ID NO: 2525 |
| >gRNA1645 | tccccgccgaaaggggcaag | SEQ ID NO: 2526 |
| >gRNA1646 | ggggcaagtagcgcgcgtcc | SEQ ID NO: 2527 |
| >gRNA1647 | gggcaagtagcgcgcgtccc | SEQ ID NO: 2528 |
| >gRNA1648 | cgcaccccttccccactcc | SEQ ID NO: 2529 |
| >gRNA1649 | gcaccccttccccactccc | SEQ ID NO: 2530 |
| >gRNA1650 | ggccaccccgccgcttcccc | SEQ ID NO: 2531 |
| >gRNA1651 | cccgccgcttccccgagatc | SEQ ID NO: 2532 |
| >gRNA1652 | gcttccccgagatccagccc | SEQ ID NO: 2533 |
| >gRNA1653 | cccgagatccagccctggac | SEQ ID NO: 2534 |
| >gRNA1654 | ccagccctggactagcccca | SEQ ID NO: 2535 |
| >gRNA1655 | gccctggactagccccacgg | SEQ ID NO: 2536 |
| >gRNA1656 | ccctggactagccccacggc | SEQ ID NO: 2537 |
| >gRNA1657 | tagccccacggcgggccacc | SEQ ID NO: 2538 |
| >gRNA1658 | agccccacggcgggccacca | SEQ ID NO: 2539 |
| >gRNA1659 | ccccacggcgggccaccaag | SEQ ID NO: 2540 |
| >gRNA1660 | gcgggccaccaaggagaact | SEQ ID NO: 2541 |
| >gRNA1661 | gggccaccaaggagaacttg | SEQ ID NO: 2542 |
| >gRNA1662 | ccaccaaggagaacttggag | SEQ ID NO: 2543 |
| >gRNA1663 | caccaaggagaacttggaga | SEQ ID NO: 2544 |
| >gRNA1664 | accaaggagaacttggagaa | SEQ ID NO: 2545 |
| >gRNA1665 | aaggagaacttggagaaggg | SEQ ID NO: 2546 |
| >gRNA1666 | aacttggagaagggaagtca | SEQ ID NO: 2547 |
| >gRNA1667 | cttggagaagggaagtcacg | SEQ ID NO: 2548 |
| >gRNA1668 | gagaagggaagtcacggagc | SEQ ID NO: 2549 |
| >gRNA1669 | gaagggaagtcacggagcga | SEQ ID NO: 2550 |
| >gRNA1670 | agggaagtcacggagcgaga | SEQ ID NO: 2551 |
| >gRNA1671 | agtcacggagcgagagagca | SEQ ID NO: 2552 |
| >gRNA1672 | acggagcgagagagcacagc | SEQ ID NO: 2553 |
| >gRNA1673 | cggagcgagagagcacagcg | SEQ ID NO: 2554 |
| >gRNA1674 | ggagcgagagagcacagcga | SEQ ID NO: 2555 |
| >gRNA1675 | agagagcacagcgagggcca | SEQ ID NO: 2556 |
| >gRNA1676 | agagcacagcgagggccaca | SEQ ID NO: 2557 |
| >gRNA1677 | gagcacagcgagggccacag | SEQ ID NO: 2558 |
| >gRNA1678 | agcacagcgagggccacaga | SEQ ID NO: 2559 |
| >gRNA1679 | agcgagggccacagagggtg | SEQ ID NO: 2560 |
| >gRNA1680 | cgagggccacagagggtgca | SEQ ID NO: 2561 |

FIG. 3 cont.

| >gRNA1681 | gggccacagagggtgcagag | SEQ ID NO: 2562 |
| --- | --- | --- |
| >gRNA1682 | ggccacagagggtgcagagc | SEQ ID NO: 2563 |
| >gRNA1683 | ccacagagggtgcagagcgg | SEQ ID NO: 2564 |
| >gRNA1684 | acagagggtgcagagcggga | SEQ ID NO: 2565 |
| >gRNA1685 | cagagggtgcagagcgggag | SEQ ID NO: 2566 |
| >gRNA1686 | agggtgcagagcgggagagg | SEQ ID NO: 2567 |
| >gRNA1687 | gggtgcagagcgggagagga | SEQ ID NO: 2568 |
| >gRNA1688 | cagagcgggagaggaaggac | SEQ ID NO: 2569 |
| >gRNA1689 | gagcgggagaggaaggacca | SEQ ID NO: 2570 |
| >gRNA1690 | cgggagaggaaggaccagag | SEQ ID NO: 2571 |
| >gRNA1691 | gggagaggaaggaccagagc | SEQ ID NO: 2572 |
| >gRNA1692 | gagaggaaggaccagagcgg | SEQ ID NO: 2573 |
| >gRNA1693 | agaggaaggaccagagcggg | SEQ ID NO: 2574 |
| >gRNA1694 | gaggaaggaccagagcggga | SEQ ID NO: 2575 |
| >gRNA1695 | gaaggaccagagcgggaggg | SEQ ID NO: 2576 |
| >gRNA1696 | aaggaccagagcgggagggt | SEQ ID NO: 2577 |
| >gRNA1697 | ggaccagagcgggagggtag | SEQ ID NO: 2578 |
| >gRNA1698 | accagagcgggagggtagga | SEQ ID NO: 2579 |
| >gRNA1699 | agggtaggagagactcacgc | SEQ ID NO: 2580 |
| >gRNA1700 | taggagagactcacgctgga | SEQ ID NO: 2581 |
| >gRNA1701 | gactcacgctggatagcctc | SEQ ID NO: 2582 |
| >gRNA1702 | actcacgctggatagcctcc | SEQ ID NO: 2583 |
| >gRNA1703 | acgctggatagcctccaggc | SEQ ID NO: 2584 |
| >gRNA1704 | tggatagcctccaggccaga | SEQ ID NO: 2585 |
| >gRNA1705 | gatagcctccaggccagaaa | SEQ ID NO: 2586 |
| >gRNA1706 | tagcctccaggccagaaaga | SEQ ID NO: 2587 |
| >gRNA1707 | gcctccaggccagaaagaga | SEQ ID NO: 2588 |
| >gRNA1708 | tccaggccagaaagagagag | SEQ ID NO: 2589 |
| >gRNA1709 | ccagaaagagagagtagcgc | SEQ ID NO: 2590 |
| >gRNA1710 | aagagagagtagcgcgagca | SEQ ID NO: 2591 |
| >gRNA1711 | agagtagcgcgagcacagct | SEQ ID NO: 2592 |
| >gRNA1712 | gagtagcgcgagcacagcta | SEQ ID NO: 2593 |
| >gRNA1713 | cgcgagcacagctaaggcca | SEQ ID NO: 2594 |
| >gRNA1714 | cgagcacagctaaggccacg | SEQ ID NO: 2595 |
| >gRNA1715 | cacagctaaggccacggagc | SEQ ID NO: 2596 |
| >gRNA1716 | ggcacggagcgagacatct | SEQ ID NO: 2597 |
| >gRNA1717 | catctcggcccgaatgctgt | SEQ ID NO: 2598 |
| >gRNA1718 | ggcccgaatgctgtcagctt | SEQ ID NO: 2599 |
| >gRNA1719 | gcccgaatgctgtcagcttc | SEQ ID NO: 2600 |
| >gRNA1720 | tcagcttcaggaatgcccgc | SEQ ID NO: 2601 |
| >gRNA1721 | acttatattaaacgcgtgcc | SEQ ID NO: 2602 |

FIG. 3 cont.

| | | |
|---|---|---|
| >gRNA1722 | taaacgcgtgcccagccaat | SEQ ID NO: 2603 |
| >gRNA1723 | aaacgcgtgcccagccaatc | SEQ ID NO: 2604 |
| >gRNA1724 | cgtgcccagccaatcaggac | SEQ ID NO: 2605 |
| >gRNA1725 | gtgcccagccaatcaggaca | SEQ ID NO: 2606 |
| >gRNA1726 | gccaatcaggacaaggcccg | SEQ ID NO: 2607 |
| >gRNA1727 | ccaatcaggacaaggcccgc | SEQ ID NO: 2608 |
| >gRNA1728 | caatcaggacaaggcccgca | SEQ ID NO: 2609 |

FIG. 3 cont.

1    MDKKYSIGLD IGTNSVGWAV ITDEYKVPSK KFKVLGNTDR HSIKKNLIGA LLFDSGETAE
61   ATRLKRTARR RYTRRKNRIC YLQEIFSNEM AKVDDSFFHR LEESFLVEED KKHERHPIFG
121  NIVDEVAYHE KYPTIYHLRK KLVDSTDKAD LRLIYLALAH MIKFRGHFLI EGDLNPDNSD
181  VDKLFIQLVQ TYNQLFEENP INASGVDAKA ILSARLSKSR RLENLIAQLP GEKKNGLFGN
241  LIALSLGLTP NFKSNFDLAE DAKLQLSKDT YDDDLDNLLA QIGDQYADLF LAAKNLSDAI
301  LLSDILRVNT EITKAPLSAS MIKRYDEHHQ DLTLLKALVR QQLPEKYKEI FFDQSKNGYA
361  GYIDGGASQE EFYKFIKPIL EKMDGTEELL VKLNREDLLR KQRTFDNGSI PHQIHLGELH
421  AILRRQEDFY PFLKDNREKI EKILTFRIPY YVGPLARGNS RFAWMTRKSE ETITPWNFEE
481  VVDKGASAQS FIERMTNFDK NLPNEKVLPK HSLLYEYFTV YNELTKVKYV TEGMRKPAFL
541  SGEQKKAIVD LLFKTNRKVT VKQLKEDYFK KIECFDSVEI SGVEDRFNAS LGTYHDLLKI
601  IKDKDFLDNE ENEDILEDIV LTLTLFEDRE MIEERLKTYA HLFDDKVMKQ LKRRRYTGWG
661  RLSRKLINGI RDKQSGKTIL DFLKSDGFAN RNFMQLIHDD SLTFKEDIQK AQVSGQGDSL
721  HEHIANLAGS PAIKKGILQT VKVVDELVKV MGRHKPENIV IEMARENQTT QKGQKNSRER
781  MKRIEEGIKE LGSQILKEHP VENTQLQNEK LYLYYLQNGR DMYVDQELDI NRLSDYDVDH
841  IVPQSFLKDD SIDNKVLTRS DKNRGKSDNV PSEEVVKKMK NYWRQLLNAK LITQRKFDNL
901  TKAERGGLSE LDKAGFIKRQ LVETRQITKH VAQILDSRMN TKYDENDKLI REVKVITLKS
961  KLVSDFRKDF QFYKVREINN YHHAHDAYLN AVVGTALIKK YPKLESEFVY GDYKVYDVRK
1021 MIAKSEQEIG KATAKYFFYS NIMNFFKTEI TLANGEIRKR PLIETNGETG EIVWDKGRDF
1081 ATVRKVLSMP QVNIVKKTEV QTGGFSKESI LPKRNSDKLI ARKKDWDPKK YGGFDSPTVA
1141 YSVLVVAKVE KGKSKKLKSV KELLGITIME RSSFEKNPID FLEAKGYKEV KKDLIIKLPK
1201 YSLFELENGR KRMLASAGEL QKGNELALPS KYVNFLYLAS HYEKLKGSPE DNEQKQLFVE
1261 QHKHYLDEII EQISEFSKRV ILADANLDKV LSAYNKHRDK PIREQAENII HLFTLTNLGA
1321 PAAFKYFDTT IDRKRYTSTK EVLDATLIHQ SITGLYETRI DLSQLGGD (SEQ ID NO: 298)

FIG. 4

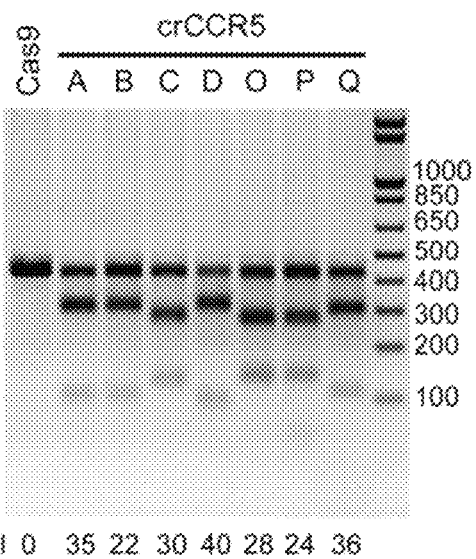
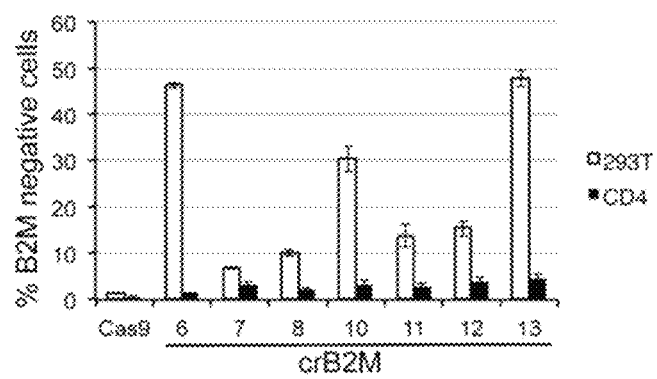
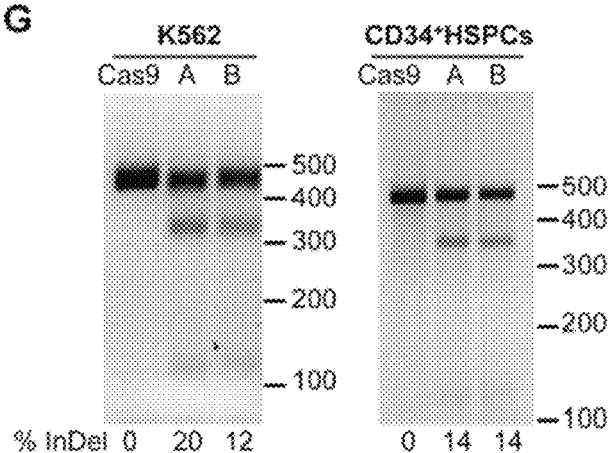
FIGS. 5E-5H

D

| crCCR5 combination | Offset in bp |
|---|---|
| C+D | 34 |
| A+B | 205 |
| D+Q | 205 |

E

| crCCR5 combination | Donors | #clones | +/- (%mean±SEM) | -/- (%mean±SEM) |
|---|---|---|---|---|
| A+B | n=4 | 460 | 13.5±4.7 | 19.3±6.8 |
| D+Q | n=4 | 387 | 15.0±5.2 | 26.8±7.1 |
| C+D | n=3 | 372 | 19.3±6.5 | 22.0±8.7 |

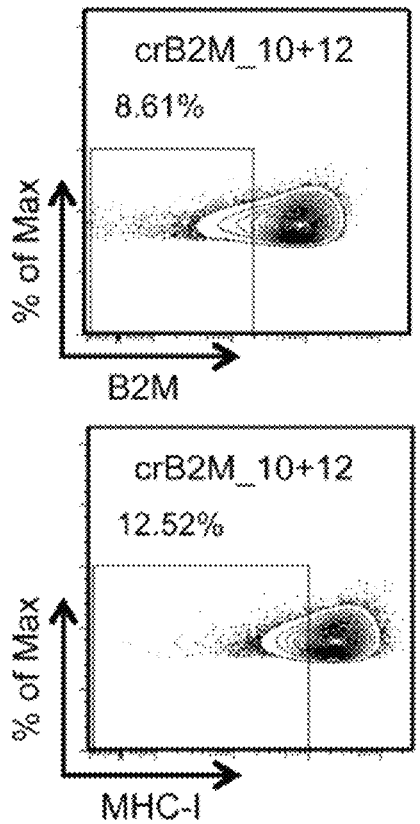
A % B2M negative cells
| crB2M | Donor 1 | Donor 2 | Donor 3 | Mean±SEM |
|---|---|---|---|---|
| 6+7 | 2.14 | 4.47 | 2.99 | 3.2±0.68 |
| 6+8 | 2.60 | 3.31 | 3.25 | 3.05±0.23 |
| 10+11 | 2.81 | 4.01 | 3.96 | 3.59±0.39 |
| 10+12 | 8.61 | 5.69 | 5.82 | 6.71±0.95 |
| 13+8 | 34.15 | 6.22 | 13.64 | 18.0±8.35 |
| 8+10 | 0.09 | 3.34 | 2.95 | 2.13±1.02 |
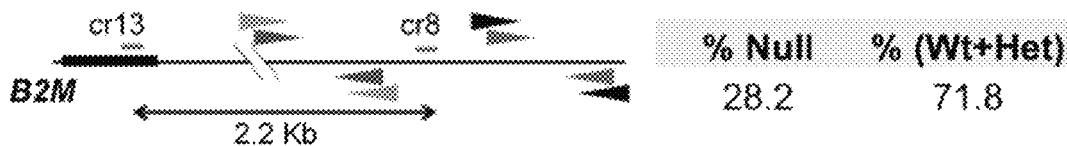
FIGS. 8A-8C

A crCCR5_A: GCTGCCGCCCAGTGGGACTTTGG      SEQ ID No: 35
  CCR2: ACTGTCTCCCTGTAGAAACTGG       SEQ ID No: 36 crCCR5_B: GATCTGGTAAAGATGATTCCGGG     SEQ ID No: 37
  CCR2: CATTTAGTAAAGATGATTCCTGG      SEQ ID No: 38 crCCR5_C: ACAATGTGTCAACTCTTGACAGG     SEQ ID No: 39
  CCR2: GCATTTTCTGTTCTC-TGA-AGT      SEQ ID No: 40 crCCR5_D: TCACTATGC-TCCCGCCCAGTGG     SEQ ID No: 41
  CCR2: TCACTAGGCATGCTGCC-AGAGC      SEQ ID No: 42 crCCR5_Q: GCTGTGTTTGCCTCTCTCCCAGG     SEQ ID No: 43
  CCR2: GCTGTGTTTGCTTCTGTCCCAGG      SEQ ID No: 44

B

| Mutation | crCCR5 treatment |||||||
|---|---|---|---|---|---|---|---|
| | B ||| A+B ||| A |||
| | Reads Supporting Mutation | Total Reads at Site | Frequency | Reads Supporting Mutation | Total Reads at Site | Frequency | Reads Supporting Mutation | Total Reads at Site | Frequency |
| One Base Insertion | 30 | 5,963 | 0.50% | 2 | 5,339 | 0.04% | 0 | 4,678 | 0.00% |
| Two Base Insertion | 0 | 5,963 | 0.00% | 1 | 5,339 | 0.02% | 0 | 4,678 | 0.00% |
| One Base Deletion | 5 | 5,963 | 0.08% | 9 | 5,339 | 0.17% | 4 | 4,678 | 0.09% |
| Two Base Deletion | 1 | 5,963 | 0.02% | 1 | 5,339 | 0.02% | 0 | 4,678 | 0.00% |
| Total | 36 | 5,963 | 0.60% | 13 | 5,339 | 0.24% | 4 | 4,678 | 0.09% |

FIGS. 9A-9B

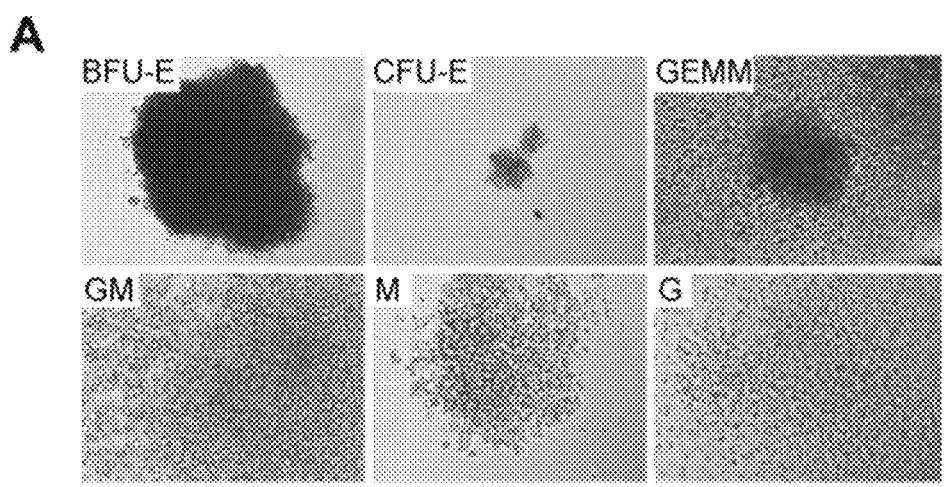
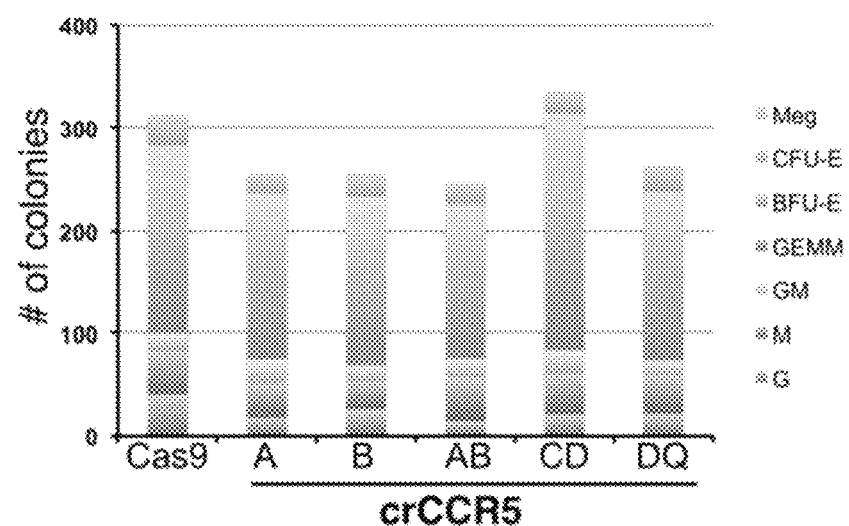
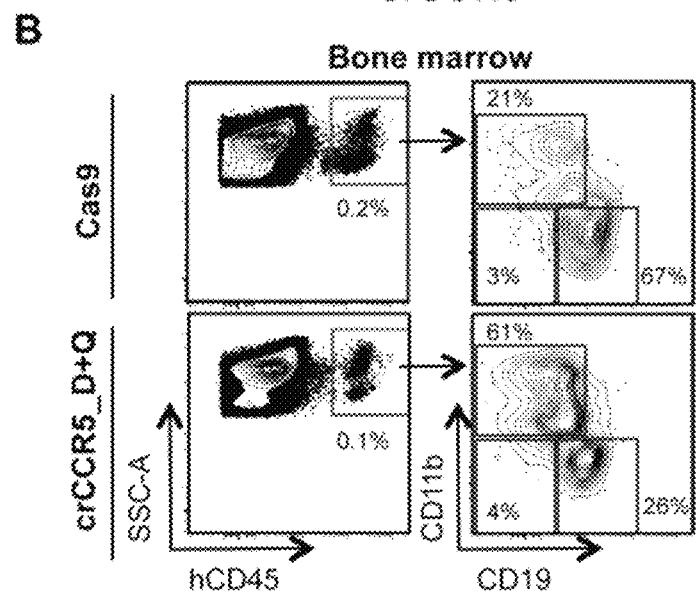
FIGS. 10A-10B

| Site | Chr | Start | End | Sequence | |
|------|-----|-------|-----|----------|---|
| guideQ_OT15 | 1 | 7,721,536 | 7,721,559 | | SEQ ID NO: 50 |
| guideB_OT23 | 1 | 26,857,084 | 26,857,107 | | SEQ ID NO: 51 |
| guideB_OT17 | 1 | 40,109,230 | 40,109,253 | | SEQ ID NO: 52 |
| guideC_OT7 | 1 | 88,021,569 | 88,021,592 | | SEQ ID NO: 53 |
| guideB_OT8 | 1 | 95,257,842 | 95,257,865 | | SEQ ID NO: 54 |
| guideB_OT26 | 1 | 95,257,842 | 95,257,865 | | SEQ ID NO: 55 |
| guideB_OT11 | 1 | 102,027,511 | 102,027,534 | | SEQ ID NO: 56 |
| guideQ_OT35 | 1 | 108,838,856 | 108,838,879 | | SEQ ID NO: 57 |
| guideQ_OT10 | 1 | 234,728,097 | 234,728,120 | | SEQ ID NO: 58 |
| guideB_OT22 | 2 | 34,792,091 | 34,792,114 | | SEQ ID NO: 59 |
| guideB_OT2 | 2 | 55,610,332 | 55,610,355 | | SEQ ID NO: 60 |
| guideD_OT4 | 2 | 65,541,463 | 65,541,486 | | SEQ ID NO: 61 |
| guideP_OT6 | 2 | 87,822,849 | 87,822,872 | | SEQ ID NO: 62 |
| guideP_OT1 | 2 | 87,822,848 | 87,822,871 | | SEQ ID NO: 63 |
| guideQ_OT4 | 2 | 105,475,698 | 105,475,721 | | SEQ ID NO: 64 |
| guideQ_OT32 | 2 | 105,475,698 | 105,475,721 | | SEQ ID NO: 65 |
| guideP_OT7 | 2 | 112,185,053 | 112,185,076 | | SEQ ID NO: 66 |
| guideB_OT6 | 2 | 112,185,053 | 112,185,076 | | SEQ ID NO: 67 |
| guideB_OT4 | 2 | 113,069,812 | 113,069,835 | | SEQ ID NO: 68 |
| guideB_OT7 | 2 | 175,176,760 | 175,176,783 | | SEQ ID NO: 69 |
| guideB_OT19 | 2 | 225,358,045 | 225,358,068 | | SEQ ID NO: 70 |
| guideQ_OT21 | 2 | 225,358,045 | 225,358,068 | | SEQ ID NO: 71 |
| guideP_OT5 | 2 | 239,253,476 | 239,253,499 | | SEQ ID NO: 72 |
| guideB_OT14 | 2 | 239,332,511 | 239,332,534 | | SEQ ID NO: 73 |
| guideP_OT20 | 3 | 46,399,495 | 46,399,518 | | SEQ ID NO: 74 |

FIG. 12

| Site | Chr | Start | End | Sequence | |
|---|---|---|---|---|---|
| guideQ_OT15 | 3 | 46,399,520 | 46,399,543 | GCTTCTTTTCTTCTCCTCCAAG | SEQ ID NO: 75 |
| guideB_OT5 | 3 | 46,399,538 | 46,399,561 | CCACGAATCATCTTTACTAAATC | SEQ ID NO: 76 |
| guideB_OT24 | 3 | 46,399,538 | 46,399,561 | CCACGAATCATCTTTACTAAATC | SEQ ID NO: 77 |
| guideD_TARGET | 3 | 46,414,654 | 46,414,677 | TCACTATCTCCTCCCCACTCCC | SEQ ID NO: 78 |
| guideA_TARGET | 3 | 46,414,661 | 46,414,684 | GCTCCCCCCAGGGAACTTTTC | SEQ ID NO: 79 |
| guideC_TARGET | 3 | 46,414,688 | 46,414,711 | ACAATGTCTCAACTCTTGACAGG | SEQ ID NO: 80 |
| guideP_TARGET | 3 | 46,414,834 | 46,414,857 | GACAAGTTGGATCACTGGGTGG | SEQ ID NO: 81 |
| guideQ_TARGET | 3 | 46,414,859 | 46,414,882 | GTTCCTTTCCCTCTCTTCCAGC | SEQ ID NO: 82 |
| guideB_TARGET | 3 | 46,414,877 | 46,414,900 | CCAGGAATCATCTTTTACTAAATC | SEQ ID NO: 83 |
| guideC_OT6 | 3 | 51,505,036 | 51,505,059 | ACAAGGGTCAACTCCCACAAG | SEQ ID NO: 84 |
| guideC_OT12 | 3 | 51,505,036 | 51,505,059 | ACAAGGGTCAACTTGGACAAG | SEQ ID NO: 85 |
| guideD_OT5 | 3 | 53,110,172 | 53,110,195 | CCACTCCCCCTCACCATCCTCC | SEQ ID NO: 86 |
| guideQ_OT28 | 3 | 64,142,989 | 64,143,012 | CCCACCCCCCACATGCAAAGACC | SEQ ID NO: 87 |
| guideC_OT21 | 3 | 94,180,887 | 94,180,910 | ACAATATTCAACACTTTACAAGG | SEQ ID NO: 88 |
| guideC_OT13 | 3 | 162,087,348 | 162,087,371 | CTTGCATCATCTTTCACACATC | SEQ ID NO: 89 |
| guideB_OT8 | 4 | 85,469,957 | 85,469,980 | GACAAGCGTGATTCCATGGGAG | SEQ ID NO: 90 |
| guideP_OT24 | 4 | 104,977,831 | 104,977,854 | CCTCCAATAATCACCCCCTTTC | SEQ ID NO: 91 |
| guideP_OT17 | 4 | 136,511,965 | 136,511,988 | CCCAAGTTCCACTGGCAGGTGGC | SEQ ID NO: 92 |
| guideA_OT10 | 5 | 13,378,669 | 13,378,692 | GCTACTTTTTCTAACTTTACAAAG | SEQ ID NO: 93 |
| guideC_OT2 | 5 | 32,668,507 | 32,668,530 | GCTACTCCCTAACTTTGACAAG | SEQ ID NO: 94 |
| guideC_OT11 | 5 | 32,668,507 | 32,668,530 | GCTACTCCCTAACTTTGACAAG | SEQ ID NO: 95 |
| guideQ_OT13 | 5 | 112,310,301 | 112,310,324 | CCACTATGCTCTCCAGTCAG | SEQ ID NO: 96 |
| guideQ_OT17 | 5 | 154,708,103 | 154,708,126 | TCTCTCCTCTCTGTCCAGTGGG | SEQ ID NO: 97 |
| guideD_OT11 | 5 | 157,424,997 | 157,425,020 | ACTCTGCATCATCTCACTGATT | SEQ ID NO: 98 |
| guideB_OT3 | 6 | 50,082,676 | 50,082,699 | CTTAGGAATCATCTCCACTGATT | SEQ ID NO: 99 |
| guideA_OT7 | 6 | 95,560,697 | 95,560,720 | CCCAAGTTCCCACTGGTTGACATG | SEQ ID NO: 100 |
| guideQ_OT23 | 6 | 149,309,103 | 149,309,126 | CTAAGCAGAGAGCGGCAACACGC | SEQ ID NO: 101 |

FIG. 12 cont.

| Site | Chr | Start | End | Sequence | |
|---|---|---|---|---|---|
| guideQ_OT1 | 6 | 151,120,563 | 151,120,586 | CCGCGGAGCCGACCGAAACCGAC | SEQ ID NO: 102 |
| guideQ_OT24 | 6 | 151,120,563 | 151,120,586 | CCGCGGAGCCGACCGAAACCGAC | SEQ ID NO: 103 |
| guideP_OT10 | 7 | 9,489,995 | 9,490,018 | CTCCCAAGTGATCCACTGGTC | SEQ ID NO: 104 |
| guideQ_OT19 | 7 | 19,928,370 | 19,928,393 | CCTGGCAGAGAACCAAACACGGA | SEQ ID NO: 105 |
| guideQ_OT13 | 7 | 26,697,753 | 26,697,776 | CTTGCTGGTTAAACTTTGATTAG | SEQ ID NO: 106 |
| guideC_OT4 | 7 | 68,108,793 | 68,108,816 | ACATTGATTGTAAACTTTGATTAG | SEQ ID NO: 107 |
| guideC_OT9 | 7 | 120,487,950 | 120,487,973 | ACAAGTTAAACTTTGGCAG | SEQ ID NO: 108 |
| guideQ_OT2 | 7 | 140,990,691 | 140,990,714 | CTCCCAAGTGATTACACTTGAT | SEQ ID NO: 109 |
| guideQ_OT16 | 7 | 141,828,674 | 141,828,697 | CCCACTCGCGCCAGCCTACTTA | SEQ ID NO: 110 |
| guideC_OT18 | 7 | 145,843,561 | 145,843,584 | CTTGTCAACATTTGCCGAGTGT | SEQ ID NO: 111 |
| guideC_OT14 | 7 | 145,843,561 | 145,843,584 | CTTGTCAACATTTGCCGAGTGT | SEQ ID NO: 112 |
| guideC_OT17 | 7 | 158,285,285 | 158,285,308 | CCTCGTGCAGCCAAACACAGCC | SEQ ID NO: 113 |
| guideQ_OT3 | 8 | 1,379,562 | 1,379,585 | CCTACTGGCATGTCATCAAGCTT | SEQ ID NO: 114 |
| guideQ_OT18 | 8 | 23,096,380 | 23,096,403 | TGACTATGGCACCACCTAGCTGA | SEQ ID NO: 115 |
| guideC_OT28 | 8 | 104,258,547 | 104,258,570 | CCAGTGGCTCTCTTCCTTACCAGTCC | SEQ ID NO: 116 |
| guideB_OT6 | 8 | 142,638,679 | 142,638,702 | CCAGTCGCCTGCCTGCTTGCC | SEQ ID NO: 117 |
| guideQ_OT2 | 9 | 2,427,359 | 2,427,382 | CCAGGCAAGTGATTACTGAAACAAC | SEQ ID NO: 118 |
| guideQ_OT27 | 9 | 2,427,359 | 2,427,382 | CCAGGCAAGTGATTACTGAAACAAC | SEQ ID NO: 119 |
| guideP_OT6 | 9 | 42,760,292 | 42,760,314 | TACATGGAGTAATGATTACTGATGGA | SEQ ID NO: 120 |
| guideP_OT9 | 9 | 42,760,292 | 42,760,314 | CTCCCAAGTGATTACTGATTGA | SEQ ID NO: 121 |
| guideP_OT10 | 9 | 42,760,292 | 42,760,314 | CTCCCAAGTGATTACTGATTGA | SEQ ID NO: 122 |
| guideQ_OT10 | 9 | 69,769,168 | 69,769,190 | TACATGGAGTAATGATTACTGATGGA | SEQ ID NO: 123 |
| guideP_OT8 | 9 | 69,769,168 | 69,769,190 | CTCCCAAGTGATTACTGATTTA | SEQ ID NO: 124 |
| guideP_OT9 | 9 | 69,769,168 | 69,769,190 | CTCCCAAGTGATTACTGATTTA | SEQ ID NO: 125 |
| guideP_OT6 | 9 | 70,135,845 | 70,135,867 | TACATGGAGTAATGATTACTGATGGA | SEQ ID NO: 126 |
| guideP_OT9 | 9 | 70,135,845 | 70,135,867 | CTCCCAAGTGATTACTGATTTA | SEQ ID NO: 127 |
| guideP_OT10 | 9 | 70,135,845 | 70,135,867 | CTCCCAAGTGATTACTGATTATTA | SEQ ID NO: 128 |

FIG. 12 cont.

| Site | Chr | Start | End | Sequence | |
|---|---|---|---|---|---|
| guideP_OT8 | 9 | 70,386,317 | 70,386,340 | TACATCCAGTAATCACTTACTCATGTAC | SEQ ID NO: 129 |
| guideP_OT9 | 9 | 70,386,317 | 70,386,339 | CTCCCAAGTGATTACTCGATGTTA | SEQ ID NO: 130 |
| guideP_OT10 | 9 | 70,386,317 | 70,386,339 | CTCCCAAGTGATTACTGATGTA | SEQ ID NO: 131 |
| guideP_OT1 | 9 | 80,982,901 | 80,982,924 | CACAAGTTCTGATCACTTCCGCCAC | SEQ ID NO: 132 |
| guideP_OT21 | 9 | 80,982,901 | 80,982,924 | CACAAGTTCTGATCACTTCCGCCAC | SEQ ID NO: 133 |
| guideP_OT5 | 9 | 117,954,855 | 117,954,878 | CTTCCATGTGATTAAGACTTTGTC | SEQ ID NO: 134 |
| guideP_OT11 | 9 | 117,954,855 | 117,954,878 | CTTCCATGTGATTAAGACTTTGTC | SEQ ID NO: 135 |
| guideP_OT20 | 10 | 3,031,086 | 3,031,109 | CTTCAGAGACAAACCAAACACATC | SEQ ID NO: 136 |
| guideB_OT19 | 10 | 20,040,235 | 20,040,258 | CAGGAATCTGTTTTACCAAATT | SEQ ID NO: 137 |
| guideP_OT9 | 10 | 42,689,588 | 42,689,611 | TACATCAGTAATCACTTGGATGTA | SEQ ID NO: 138 |
| guideP_OT8 | 10 | 42,689,588 | 42,689,610 | TACATCAGTAATCACTTGGATGTA | SEQ ID NO: 139 |
| guideP_OT10 | 10 | 42,689,588 | 42,689,610 | CTCCAAGTGTCTCCTCCTGGG | SEQ ID NO: 140 |
| guideQ_OT9 | 10 | 47,655,769 | 47,655,792 | CCGTTCAGGGTGGACAGATACAGA | SEQ ID NO: 141 |
| guideD_OT7 | 10 | 77,359,062 | 77,358,085 | GCTGTGCTCCTCAAGAAAGCTTGGG | SEQ ID NO: 142 |
| guideQ_OT31 | 10 | 77,359,062 | 77,358,085 | GCTGTGCTCCTCAAGAAAGCTTGGG | SEQ ID NO: 143 |
| guideB_OT15 | 10 | 88,295,312 | 88,295,335 | GCTGGAGCAGCAGCAGGACTGGG | SEQ ID NO: 144 |
| guideQ_OT34 | 10 | 96,895,438 | 96,895,461 | GCTGGAACTGGATTGTTGCCAAG | SEQ ID NO: 145 |
| guideQ_OT8 | 10 | 117,958,114 | 117,958,137 | CCGTGTTTTCTCCTGCTCCAAG | SEQ ID NO: 146 |
| guideQ_OT11 | 10 | 117,958,114 | 117,958,137 | CCGTGTTTTCTCCTGCTCCAAG | SEQ ID NO: 147 |
| guideD_OT7 | 10 | 129,722,982 | 129,723,005 | CCGACTGGGTTGCAGAATACAGA | SEQ ID NO: 148 |
| guideP_OT25 | 10 | 131,328,679 | 131,328,702 | CCCCAAAAGAAGAGGAAGTTTTC | SEQ ID NO: 149 |
| guideA_OT16 | 11 | 2,952,375 | 2,952,398 | CTGGCCAGACAATGCAAGACTGGG | SEQ ID NO: 150 |
| guideP_OT14 | 11 | 36,441,686 | 36,441,709 | CTCCATTGAACACATTTACTAGA | SEQ ID NO: 151 |
| guideQ_OT25 | 11 | 45,632,027 | 45,632,050 | CTGCAAGTTTTCCTCCCCAAG | SEQ ID NO: 152 |
| guideB_OT25 | 11 | 58,575,305 | 58,575,328 | CCCAAAATAATGTCCCAAGCTC | SEQ ID NO: 153 |
| guideQ_OT22 | 11 | 62,783,309 | 62,783,332 | GCTGTCTTTCTCCTCCCAAG | SEQ ID NO: 154 |
| guideC_OT10 | 11 | 77,709,742 | 77,709,765 | ACAATCTTTGCCTTGACTAC | SEQ ID NO: 155 |

FIG. 12 cont.

| Site | Chr | Start | End | Sequence | |
|---|---|---|---|---|---|
| guideC_OT19 | 11 | 77,709,742 | 77,709,765 | ACAATCTTTCCTCTTCCTTGACTTAC | SEQ ID NO: 156 |
| guideP_OT26 | 11 | 115,496,055 | 115,496,078 | GACAAATCTGACAATCGATTTCCCAGC | SEQ ID NO: 157 |
| guideQ_OT26 | 12 | 4,379,232 | 4,379,355 | CCACGCGAAACACAAACACACC | SEQ ID NO: 158 |
| guideC_OT1 | 12 | 12,976,312 | 12,976,335 | AAAATCTCTCAACTCTTCATTAC | SEQ ID NO: 159 |
| guideC_OT16 | 12 | 12,976,312 | 12,976,335 | AAAATCTCTCAACTCTTCATTAC | SEQ ID NO: 160 |
| guideQ_OT21 | 12 | 19,270,661 | 19,270,684 | TCTGTGTTTGCTCTCTCTCTCTCAAG | SEQ ID NO: 161 |
| guideC_OT18 | 12 | 53,711,726 | 53,711,749 | ACAACGTTTCCAACTCTCAGCTAAG | SEQ ID NO: 162 |
| guideP_OT12 | 12 | 81,881,220 | 81,881,243 | GACAGTTTGGACACTTCCTAAAG | SEQ ID NO: 163 |
| guideP_OT14 | 12 | 94,429,361 | 94,429,384 | GACATTTTGAAACATTTGGGAAAC | SEQ ID NO: 164 |
| guideP_OT4 | 12 | 98,582,748 | 98,582,771 | GACACTGATTTCTCTTTCCCAAAG | SEQ ID NO: 165 |
| guideP_OT18 | 12 | 98,582,748 | 98,582,771 | CCAAACTCCACTGCCTCAAGCATC | SEQ ID NO: 166 |
| guideA_OT3 | 12 | 108,460,819 | 108,460,842 | CTTGCAGGCCCACTCTCGGAGCACC | SEQ ID NO: 167 |
| guideA_OT13 | 12 | 108,460,819 | 108,460,842 | CCCCGGCTCCACTCTCGGAGCACC | SEQ ID NO: 168 |
| guideC_OT18 | 13 | 20,693,503 | 20,693,526 | GCTGCAGCCCACTCTCGGAGCACC | SEQ ID NO: 169 |
| guideA_OT9 | 13 | 21,047,396 | 21,047,419 | GATTTGGGAAAGATCATTCCTAG | SEQ ID NO: 170 |
| guideA_OT14 | 13 | 21,047,396 | 21,047,419 | GTTTGTGTAAGTTCATTCCTAG | SEQ ID NO: 171 |
| guideP_OT22 | 13 | 25,242,593 | 25,242,616 | GACAACTTCCATAATCATTCCTAG | SEQ ID NO: 172 |
| guideR_OT15 | 13 | 42,388,792 | 42,388,815 | GATTTCGGAAAGATCATTCCTAG | SEQ ID NO: 173 |
| guideB_OT9 | 13 | 69,477,970 | 69,477,993 | GTTCTGTAAGTTCATTCCTAG | SEQ ID NO: 174 |
| guideC_OT5 | 13 | 94,575,221 | 94,575,244 | AAACTTTGCAAGATGATTCCTCTCC | SEQ ID NO: 175 |
| guideA_OT6 | 13 | 56,740,798 | 56,740,821 | CCTAAGTCCACTGGCCCGAAGT | SEQ ID NO: 176 |
| guideB_OT20 | 14 | 73,729,934 | 73,729,957 | GTTTCTGTAAGATCATTCCTCTG | SEQ ID NO: 177 |
| guideA_OT17 | 14 | 76,844,953 | 76,844,976 | CCAGACCCCACTTCTCGGACGCC | SEQ ID NO: 178 |
| guideC_OT3 | 14 | 98,955,845 | 98,955,868 | AAAATCTCTCAACTCTTGAATAC | SEQ ID NO: 179 |
| guideC_OT17 | 14 | 98,955,845 | 98,955,868 | AAAATTTTCTCAACTCTTGAATAG | SEQ ID NO: 180 |
| guideC_OT23 | 14 | 103,419,411 | 103,419,434 | CTGCAGACACCTGACACCATTTTT | SEQ ID NO: 181 |
| guideQ_OT30 | 14 | 105,212,041 | 105,212,064 | CCAGGGCGCACGGAAACCTCTGC | SEQ ID NO: 182 |

FIG. 12 cont.

| Site | Chr | Start | End | Sequence | |
|---|---|---|---|---|---|
| guideD_OT11 | 15 | 27,937,804 | 27,937,827 | TGACTTTGCTGCTGACAGATTCGG | SEQ ID NO: 183 |
| guideA_OT8 | 15 | 28,812,084 | 28,812,107 | CCCGAAGTTCCGACTGCGTGGCTCGT | SEQ ID NO: 184 |
| guideA_OT4 | 15 | 30,815,608 | 30,815,631 | GCACCACCCAGTTGCGATTGCTGAG | SEQ ID NO: 185 |
| guideA_OT3 | 15 | 30,815,608 | 30,815,631 | GCACCAGCCCATTGGACATTCCAG | SEQ ID NO: 186 |
| guideA_OT4 | 15 | 32,776,439 | 32,776,462 | GCACCAGCCATTGGACATTCCAG | SEQ ID NO: 187 |
| guideA_OT5 | 15 | 32,776,439 | 32,776,462 | GCACAGGCATGGACAATCCAG | SEQ ID NO: 188 |
| guideQ_OT29 | 15 | 58,817,723 | 58,817,746 | CCAGGAAGGACCCCGATTCAG | SEQ ID NO: 189 |
| guideD_OT3 | 16 | 17,377,804 | 17,377,827 | CCACTATACACCCCACTATGAG | SEQ ID NO: 190 |
| guideD_OT10 | 16 | 34,381,274 | 34,381,297 | CGCTTGTCCTCGGAGCAGATCCAAG | SEQ ID NO: 191 |
| guideB_OT1 | 16 | 66,123,576 | 66,123,599 | GATTTCCGAAAGATGATTCCAAG | SEQ ID NO: 192 |
| guideE_OT36 | 17 | 11,833,418 | 11,833,441 | CATTGCAGAGAGGAAAAGAGT | SEQ ID NO: 193 |
| guideQ_OT8 | 17 | 18,078,932 | 18,078,955 | GCTGGATCGTGGTCTTCCCGAG | SEQ ID NO: 194 |
| guideQ_OT33 | 17 | 18,078,932 | 18,078,955 | CCTGAATCCTGGCTTTCCCAGATCC | SEQ ID NO: 195 |
| guideB_OT12 | 17 | 21,284,681 | 21,284,903 | CCTGGAATCCTTTCCCAGATCC | SEQ ID NO: 196 |
| guideB_OT13 | 17 | 21,284,681 | 21,284,903 | CCTGGAATCTTGAGGATATTCTTC | SEQ ID NO: 197 |
| guideP_OT23 | 17 | 59,679,562 | 59,679,585 | GCLAGACTTGAGACATTGGAGC | SEQ ID NO: 198 |
| guideP_OT16 | 17 | 66,415,053 | 66,415,076 | GACACTTTGAAGATATTTCAAG | SEQ ID NO: 199 |
| guideQ_OT5 | 18 | 11,204,603 | 11,204,626 | CTTTGGAGAGCCAGAGACTCAG | SEQ ID NO: 200 |
| guideQ_OT12 | 18 | 11,204,603 | 11,204,626 | CTTTGGAGAGCCAGAGACTTG | SEQ ID NO: 201 |
| guideB_OT12 | 18 | 12,705,728 | 12,705,751 | CCTCGAATCTTTTGCAGATC | SEQ ID NO: 202 |
| guideB_OT13 | 18 | 12,705,728 | 12,705,751 | CCTGGAATCTTGCCAGATC | SEQ ID NO: 203 |
| guideP_OT19 | 18 | 41,187,999 | 41,188,022 | CTACTTGACTGCTTGATATTTGTC | SEQ ID NO: 204 |
| guideP_OT27 | 18 | 69,924,495 | 69,924,518 | CCAAAATTATTTATTTGACATTC | SEQ ID NO: 205 |
| guideA_OT2 | 19 | 35,800,794 | 35,800,817 | CCTGGACCCCACTGCTTGGGCAG | SEQ ID NO: 206 |
| guideQ_OT14 | 20 | 23,302,200 | 23,302,223 | CTTGGAAGGCGGAAACGTTCCAG | SEQ ID NO: 207 |
| guideB_OT18 | 20 | 23,472,840 | 23,472,863 | GATTCTTGATAAGTTGCCAGATCGG | SEQ ID NO: 208 |
| guideD_OT2 | 20 | 37,102,053 | 37,102,076 | CCACTTGCTCCCCGATTCAGG | SEQ ID NO: 209 |

FIG. 12 cont.

| Site | Chr | Start | End | Sequence | |
|---|---|---|---|---|---|
| guideP_OT8 | 21 | 9,588,789 | 9,588,811 | TACATCAGTAATCACTTGGCAAG | SEQ ID NO: 210 |
| guideP_OT9 | 21 | 9,588,789 | 9,588,811 | CTCCCAACTCATTACTCATGTA | SEQ ID NO: 211 |
| guideP_OT10 | 21 | 9,588,789 | 9,588,811 | CTCCCAACTCATTACTCATGTA | SEQ ID NO: 212 |
| guideQ_OT3 | 21 | 32,760,114 | 32,760,137 | GCACTGTGTCGCTCTCTCCAGG | SEQ ID NO: 213 |
| guideQ_OT16 | 21 | 32,760,114 | 32,760,137 | TACATCAGTAATCACTTGGCAAG | SEQ ID NO: 214 |
| guideP_OT8 | 22 | 17,376,827 | 17,376,849 | CTCCCAACTCATTACTCATGTA | SEQ ID NO: 215 |
| guideP_OT9 | 22 | 17,376,827 | 17,376,849 | CTCCCAACTCATTACTCATGTA | SEQ ID NO: 216 |
| guideP_OT10 | 22 | 17,376,827 | 17,376,849 | CTCCCAACTCATTACTCATGTA | SEQ ID NO: 217 |
| guideA_OT12 | 22 | 30,136,704 | 30,136,727 | CGAAGTCGCACTGGCCTGCAGC | SEQ ID NO: 218 |
| guideB_OT16 | 22 | 45,907,886 | 45,907,909 | CATCTGGCAGCAGAAATTCCAGG | SEQ ID NO: 219 |
| guideC_OT20 | X | 6,258,801 | 6,258,824 | CTCGGAAACAGTTCATAACATACT | SEQ ID NO: 220 |
| guideC_OT15 | X | 21,926,730 | 21,926,753 | CTCCCAACTCATTACTCATGGT | SEQ ID NO: 221 |
| guideP_OT15 | X | 32,405,319 | 32,405,342 | GCTAAGTGTCATAACTTCGCAAG | SEQ ID NO: 222 |
| guideC_OT22 | X | 64,736,013 | 64,736,036 | KTAATCTGTCAACTCGACCACC | SEQ ID NO: 223 |
| guideA_OT1 | X | 70,836,963 | 70,836,986 | CGAAGACCCGCTGGACGGCAGC | SEQ ID NO: 224 |
| guideA_OT11 | X | 70,836,963 | 70,836,986 | CGAAGACCCGCTGGACGGCAGC | SEQ ID NO: 225 |
| guideD_OT8 | X | 106,847,189 | 106,847,212 | CGAACTGCGCGGCAGCTGTTCA | SEQ ID NO: 226 |
| guideD_OT12 | X | 106,847,189 | 106,847,212 | CGAACTGCGCGGCAGCTGTTGA | SEQ ID NO: 227 |

| Allele | Cas9 Guide Site | Sequence | Split Reads (+) Strand / (-) Strand / TOTAL | Estimated Allele Frequency | |
|---|---|---|---|---|---|
| Reference | D (Distal) | | 1602 / 1261 / 2863 | 54.53% | SEQ ID NO: 309 |
| Reference | Q (Proximal) | | 1296 / 1535 / 2831 | 52.82% | SEQ ID NO: 310 |
| 203bp deletion | DQ (Both) | | 332 / 269 / 601 | 11.21% | SEQ ID NO: 311/312 |
| 205bp deletion | DQ (Both) | | 321 / 248 / 569 | 10.62% | SEQ ID NO: 313/314 |
| 204bp deletion | DQ (Both) | | 235 / 278 / 513 | 9.57% | SEQ ID NO: 315/316 |
| 204bp deletion | DQ (Both) | | 223 / 273 / 496 | 9.25% | SEQ ID NO: 317/318 |
| 205bp inversion | DQ (Both) | | 48 / 41 / 89 | 1.66% | SEQ ID NO: 319/320 |
| 19bp deletion | D (Distal) | | 41 / 24 / 65 | 1.21% | SEQ ID NO: 321/322 |
| 206bp inversion | DQ (Both) | | 28 / 16 / 44 | 0.82% | SEQ ID NO: 323/324 |
| T insertion | D (Distal) | | 8 / 9 / 17 | 0.32% | SEQ ID NO: 325/326 |
| T insertion | Q (Proximal) | | 7 / 8 / 15 | 0.28% | SEQ ID NO: 327/328 |
| 203bp deletion | DQ (Both) | | 4 / 9 / 13 | 0.24% | SEQ ID NO: 329/330 |
| Unidentifiable novel sequence insertion | Q (Proximal) | | 5 / 7 / 12 | 0.22% | SEQ ID NO: 331/332 |
| 203bp deletion | DQ (Both) | | 4 / 6 / 10 | 0.19% | SEQ ID NO: 333/334 |
| 208bp deletion | DQ (Both) | | 4 / 5 / 9 | 0.17% | SEQ ID NO: 335/336 |
| 207bp deletion | DQ (Both) | | 2 / 7 / 9 | 0.17% | SEQ ID NO: 337/338 |
| 199bp deletion w/ TA insertion | D (Distal) | | 6 / 2 / 8 | 0.16% | SEQ ID NO: 339/340 |
| 203bp deletion | DQ (Both) | | 4 / 3 / 7 | 0.15% | SEQ ID NO: 341/342 |
| 213bp deletion | DQ (Both) | | 3 / 4 / 7 | 0.13% | SEQ ID NO: 343/344 |
| Unidentifiable novel sequence insertion | D (Distal) | | 3 / 3 / 6 | 0.11% | SEQ ID NO: 345/346 |
| C insertion | D (Distal) | | 2 / 3 / 5 | 0.09% | SEQ ID NO: 347/348 |
| 2bp deletion | D (Distal) | | 2 / 3 / 5 | 0.09% | SEQ ID NO: 349/350 |
| 14bp deletion | D (Distal) | | 0 / 5 / 5 | 0.09% | SEQ ID NO: 351/352 |

| Guide | Degenerate Sequence | Predicted Binding Site | | | Fisher's Exact Test p | | N-Fold Enrichment | | |
|---|---|---|---|---|---|---|---|---|---|
| | | Chr | Start | End | InDel | Split | InDel | Split | |
| B | CCAGGAACAATCTTACTAAATG | 3 | 46,309,538 | 46,309,561 | 4.4x10^-13 | 1.0000 | 3.51 | 0.47 | SEQ ID NO: 412 |
| B | CCAGGCAACTTCTTTACCAGCTC | 8 | 104,258,547 | 104,258,570 | 0.0165 | 1.0000 | 1.93 | 0.45 | SEQ ID NO: 413 |
| C | AAAATGTCAACTCTTGATTAG | 12 | 12,976,312 | 12,976,335 | 0.0361 | 1.0000 | 1.56 | 0.27 | SEQ ID NO: 414 |
| C | AAAATGTCAACTCTTGATTAG | 12 | 12,976,312 | 12,976,335 | 0.0361 | 1.0000 | 1.56 | 0.27 | SEQ ID NO: 415 |
| C | CCCACTGGGCTGCAGAATACAGA | 10 | 129,722,982 | 129,723,006 | 0.0338 | 0.9996 | 1.82 | 0.50 | SEQ ID NO: 416 |
| Q | TCTGTGTTTGCCTCTCTCCCAGG | 12 | 10,270,661 | 10,270,684 | 0.0086 | 1.0000 | 2.08 | 0.20 | SEQ ID NO: 417 |
| Q | CCCGGGAGGAGGCAAAAAAGC | 17 | 11,833,418 | 11,833,441 | 0.0083 | 1.0000 | 2.24 | 0.20 | SEQ ID NO: 418 |

B

| gRNA | gRNA Combinations Tested | On-Target Site | | Most Significant Off-Target Site | |
|---|---|---|---|---|---|
| | | Mutation Frequency | Variant Read Enrichment (Treatment vs. Control) | Variant Read Enrichment (Treatment vs. Control) | Fisher's Exact p (Treatment vs Control) |
| A | A, AB | 5.78% | 58.59 | 1.84 | 0.1616 |
| B | B, AB | 16.65% | 51.02 | 3.51 | 4.4x10^-13 |
| C | C, CD | 17.00% | 30.88 | 1.56 | 0.0361 |
| D | D, CD, DQ | 26.23% | 57.64 | 1.82 | 0.0338 |
| Q | DQ | 21.19% | 46.84 | 2.24 | 0.0083 |

FIGS. 16A-16B

| Target Sequence (5' to 3') | |
|---|---|
| TTTAATATAAGTGGAGGCGTCGCGCTG | SEQ ID NO: 419 |
| TTTCTGGCCTGGAGGCTATCCAGCGTG | SEQ ID NO: 420 |
| TTTCGGCGGGGAGCAGGGGAGACCTTT | SEQ ID NO: 421 |
| TTTGGCCTACGGCGACGGGAGGGTCGG | SEQ ID NO: 422 |
| TTTGTCCCGACCCTCCCGTCGCCGTAG | SEQ ID NO: 423 |
| TTTAGGGCGTCGATAAGCGTCAGAGCG | SEQ ID NO: 424 |
| TTTCTCTTCCGCTCTTTCGCGGGGCCT | SEQ ID NO: 425 |
| TTTCGCGGGGCCTCTGGCTCCCCAGC | SEQ ID NO: 426 |
| TTTGGGACGAGCCTACCCGTCCCCAC | SEQ ID NO: 427 |
| TTTGTGAACGCGTGGAGGGGCGCTTGG | SEQ ID NO: 428 |
| TTTCCTCCCCACGGTGTGGCCCCACAT | SEQ ID NO: 429 |
| TTTGTAGAATGCTTGGCTGTGATACAA | SEQ ID NO: 430 |
| TTTGTATCACAGCCAAGCATTCTACAA | SEQ ID NO: 431 |
| TTTCGAATAATTAACTTATTTGTTCCC | SEQ ID NO: 432 |
| TTTGTTCCCATCACATGTCACTTTTAA | SEQ ID NO: 433 |
| TTTAAAAGTGACATGTGATGGGAACAA | SEQ ID NO: 434 |
| TTTTAAAAGTGACATGTGATGGGAACA | SEQ ID NO: 435 |
| TTTTTAAAAGTGACATGTGATGGGAAC | SEQ ID NO: 436 |
| TTTTTTAAAAGTGACATGTGATGGGAA | SEQ ID NO: 437 |
| TTTTAAAAAATTATAAGAACTACCCGT | SEQ ID NO: 438 |
| TTTAAAAAATTATAAGAACTACCCGTT | SEQ ID NO: 439 |
| TTTCTGTGTGCCAAGGACTTTATGTGC | SEQ ID NO: 440 |
| TTTATGTGCTTTGCGTCATTTAATTTT | SEQ ID NO: 441 |
| TTTCAAAATTAAATGACGCAAAGCACA | SEQ ID NO: 442 |
| TTTTCAAAATTAAATGACGCAAAGCAC | SEQ ID NO: 443 |
| TTTGCGTCATTTAATTTTGAAAACAGT | SEQ ID NO: 444 |
| TTTAATTTTGAAAACAGTTATCTTCCG | SEQ ID NO: 445 |
| TTTTGAAAACAGTTATCTTCCGCCATA | SEQ ID NO: 446 |
| TTTGAAAACAGTTATCTTCCGCCATAG | SEQ ID NO: 447 |
| TTTCTTCATCTGTGAGAGGCAGAAGAT | SEQ ID NO: 448 |
| TTTCTTAAAATCTCGGTGCCTTAGTTT | SEQ ID NO: 449 |
| TTTTAAGAAACTTAATTACACAGGGGA | SEQ ID NO: 450 |
| TTTAAGAAACTTAATTACACAGGGGAT | SEQ ID NO: 451 |
| TTTATCCCTGTGTAATTAAGTTTCTT | SEQ ID NO: 452 |
| TTTTGCGGGAGCGCATGCCTTTTGGCT | SEQ ID NO: 453 |
| TTTGCGGGAGCGCATGCCTTTTGGCTG | SEQ ID NO: 454 |
| TTTTGGCTGTAATTCGTGCATTTTTTT | SEQ ID NO: 455 |
| TTTGGCTGTAATTCGTGCATTTTTTTT | SEQ ID NO: 456 |
| TTTCTTAAAAAAAATGCACGAATTAC | SEQ ID NO: 457 |
| TTTTCTTAAAAAAAATGCACGAATTA | SEQ ID NO: 458 |

FIG. 17

| | |
|---|---|
| TTTTTCTTAAAAAAAAATGCACGAATT | SEQ ID NO: 459 |
| TTTTTTTTTAAGAAAAACGCCTGCCTT | SEQ ID NO: 460 |
| TTTTTTTTAAGAAAAACGCCTGCCTTC | SEQ ID NO: 461 |
| TTTTTTTAAGAAAAACGCCTGCCTTCT | SEQ ID NO: 462 |
| TTTTTTAAGAAAAACGCCTGCCTTCTG | SEQ ID NO: 463 |
| TTTTTAAGAAAAACGCCTGCCTTCTGC | SEQ ID NO: 464 |
| TTTTAAGAAAAACGCCTGCCTTCTGCG | SEQ ID NO: 465 |
| TTTAAGAAAAACGCCTGCCTTCTGCGT | SEQ ID NO: 466 |
| TTTGCTCTGGAGAATCTCACGCAGAAG | SEQ ID NO: 467 |
| TTTTCGTACAGAGGGCTTCCTCTTTGG | SEQ ID NO: 468 |
| TTTCGTACAGAGGGCTTCCTCTTTGGC | SEQ ID NO: 469 |
| TTTGGCTCTTTGCCTGGTTGTTTCCAA | SEQ ID NO: 470 |
| TTTGCCTGGTTGTTTCCAAGATGTACT | SEQ ID NO: 471 |
| TTTCCAAGATGTACTGTGCCTCTTACT | SEQ ID NO: 472 |
| TTTCAAAACCGAAAGTAAGAGGCACAG | SEQ ID NO: 473 |
| TTTTCAAAACCGAAAGTAAGAGGCACA | SEQ ID NO: 474 |
| TTTCGGTTTTGAAAACATGAGGGGGTT | SEQ ID NO: 475 |
| TTTTGAAAACATGAGGGGGTTGGGCGT | SEQ ID NO: 476 |
| TTTGAAAACATGAGGGGGTTGGGCGTG | SEQ ID NO: 477 |
| TTTGTAGAGACCAGGCTTCACCATGTT | SEQ ID NO: 478 |
| TTTTGTAGAGACCAGGCTTCACCATGT | SEQ ID NO: 479 |
| TTTTTGTAGAGACCAGGCTTCACCATG | SEQ ID NO: 480 |
| TTTTTTGTAGAGACCAGGCTTCACCAT | SEQ ID NO: 481 |
| TTTGTTATTATTTTTTGTAGAGACCAG | SEQ ID NO: 482 |
| TTTTGTTATTATTTTTTGTAGAGACCA | SEQ ID NO: 483 |
| TTTTTGTTATTATTTTTTGTAGAGACC | SEQ ID NO: 484 |
| TTTTTGAGCTATCATGGCGCCAGTGCAC | SEQ ID NO: 485 |
| TTTGAGCTATCATGGCGCCAGTGCACT | SEQ ID NO: 486 |
| TTTGAGAGACAGGGTCTCGCTCTGTTG | SEQ ID NO: 487 |
| TTTTGAGAGACAGGGTCTCGCTCTGTT | SEQ ID NO: 488 |
| TTTTTGAGAGACAGGGTCTCGCTCTGT | SEQ ID NO: 489 |
| TTTTTTGAGAGACAGGGTCTCGCTCTG | SEQ ID NO: 490 |
| TTTCTTTTTTGAGAGACAGGGTCTCGC | SEQ ID NO: 491 |
| TTTTCTTTTTTGAGAGACAGGGTCTCG | SEQ ID NO: 492 |
| TTTTTCTTTTTTGAGAGACAGGGTCTC | SEQ ID NO: 493 |
| TTTTTTCTTTTTTGAGAGACAGGGTCT | SEQ ID NO: 494 |
| TTTTTTTCTTTTTTGAGAGACAGGGTC | SEQ ID NO: 495 |
| TTTTTTTTCTTTTTTGAGAGACAGGGT | SEQ ID NO: 496 |
| TTTTTTTTTCTTTTTTGAGAGACAGGG | SEQ ID NO: 497 |
| TTTTTTTTTTCTTTTTTGAGAGACAGG | SEQ ID NO: 498 |
| TTTTTTTTTTTCTTTTTTGAGAGACAG | SEQ ID NO: 499 |

FIG. 17 cont.

| Sequence | SEQ ID |
|---|---|
| TTTTTTTTTTTCTTTTTTGAGAGACA | SEQ ID NO: 500 |
| TTTTTTTTTTTCTTTTTTGAGAGAC | SEQ ID NO: 501 |
| TTTTTTTTTTTCTTTTTTGAGAGA | SEQ ID NO: 502 |
| TTTTTTTTTTTCTTTTTTGAGAG | SEQ ID NO: 503 |
| TTTCTTTTTTTTTTTTCTTTTTTG | SEQ ID NO: 504 |
| TTTCTCTTTCTTTTTTTTTTTTCT | SEQ ID NO: 505 |
| TTTTCTCTTTCTTTTTTTTTTTTC | SEQ ID NO: 506 |
| TTTCTTTTCTCTTTCTTTTTTTTTT | SEQ ID NO: 507 |
| TTTTCTTTTCTCTTTCTTTTTTTT | SEQ ID NO: 508 |
| TTTCTTTTCTTTTCTCTTTCTTTTTT | SEQ ID NO: 509 |
| TTTCTTTCTTTTCTTTTCTCTTTCTTT | SEQ ID NO: 510 |
| TTTACAGCTCCCCTGACTGACAAACCT | SEQ ID NO: 511 |
| TTTTACAGCTCCCCTGACTGACAAACC | SEQ ID NO: 512 |
| TTTGTCAGTCAGGGGAGCTGTAAAACC | SEQ ID NO: 513 |
| TTTATTAATGGTTTTACAGCTCCCCTG | SEQ ID NO: 514 |
| TTTCTAAGTACCTGGCAATACACTAAG | SEQ ID NO: 515 |
| TTTGCCAGAGGAAAAGGTGAGCGCGCT | SEQ ID NO: 516 |
| TTTTGCCAGAGGAAAAGGTGAGCGCGC | SEQ ID NO: 517 |
| TTTTCCTCTGGCAAAACATGATCGAAA | SEQ ID NO: 518 |
| TTTCGATCATGTTTTGCCAGAGGAAAA | SEQ ID NO: 519 |
| TTTCCTCTGGCAAAACATGATCGAAAG | SEQ ID NO: 520 |
| TTTCTCATGATCAAAACATTCTGCTTT | SEQ ID NO: 521 |
| TTTTCTCATGATCAAAACATTCTGCTT | SEQ ID NO: 522 |
| TTTTGATCATGAGAAAATTGCATTTAA | SEQ ID NO: 523 |
| TTTGATCATGAGAAAATTGCATTTAAT | SEQ ID NO: 524 |
| TTTAATTTGAATACAATTTATTTACAA | SEQ ID NO: 525 |
| TTTGAATACAATTTATTTACAACATAA | SEQ ID NO: 526 |
| TTTATGTTGTAAATAAATTGTATTCAA | SEQ ID NO: 527 |
| TTTATTTACAACATAAAGGATAATGTA | SEQ ID NO: 528 |
| TTTACAACATAAAGGATAATGTATATA | SEQ ID NO: 529 |
| TTTGCTGGTTATGTTAGATGTCATTTT | SEQ ID NO: 530 |
| TTTAAAATGACATCTAACATAACCAGC | SEQ ID NO: 531 |
| TTTTAAAATGACATCTAACATAACCAG | SEQ ID NO: 532 |
| TTTTTAAAATGACATCTAACATAACCA | SEQ ID NO: 533 |
| TTTTTTAAAATGACATCTAACATAACC | SEQ ID NO: 534 |
| TTTTAAAAATAACAATCTGATATTTA | SEQ ID NO: 535 |
| TTTAAAAAATAACAATCTGATATTTAA | SEQ ID NO: 536 |
| TTTAAATATCAGATTGTTATTTTTTAA | SEQ ID NO: 537 |
| TTTTAAATATCAGATTGTTATTTTTTA | SEQ ID NO: 538 |
| TTTTTAAATATCAGATTGTTATTTTTT | SEQ ID NO: 539 |
| TTTTTTAAATATCAGATTGTTATTTTT | SEQ ID NO: 540 |

FIG. 17 cont.

| Sequence | SEQ ID |
|---|---|
| TTTTTTTAAATATCAGATTGTTATTTT | SEQ ID NO: 541 |
| TTTTTTTTAAATATCAGATTGTTATTT | SEQ ID NO: 542 |
| TTTTTTTTTAAATATCAGATTGTTATT | SEQ ID NO: 543 |
| TTTCAAAATAAGATTTTTTTTAAATA | SEQ ID NO: 544 |
| TTTTCAAAATAAGATTTTTTTTAAAT | SEQ ID NO: 545 |
| TTTAAAAAAAAATCTTATTTTGAAAAT | SEQ ID NO: 546 |
| TTTGGAAATTTTCAAAATAAGATTTTT | SEQ ID NO: 547 |
| TTTTGAAAATTTCCAAAGTAATACATG | SEQ ID NO: 548 |
| TTTGAAAATTTCCAAAGTAATACATGC | SEQ ID NO: 549 |
| TTTCCAAAGTAATACATGCCATGCATA | SEQ ID NO: 550 |
| TTTCTTGTGGTATCTTCCAGAAATGGT | SEQ ID NO: 551 |
| TTTCTGGAAGATACCACAAGAAACATG | SEQ ID NO: 552 |
| TTTTCCTCCTCTGACCTGTGTGTGGGT | SEQ ID NO: 553 |
| TTTCCTCCTCTGACCTGTGTGTGGGTT | SEQ ID NO: 554 |
| TTTTGTTTTGTTTTACTGTGGGCATA | SEQ ID NO: 555 |
| TTTGTTTTTGTTTTACTGTGGGCATAA | SEQ ID NO: 556 |
| TTTATGCCCACAGTAAAACAAAAACAA | SEQ ID NO: 557 |
| TTTTTGTTTTACTGTGGGCATAAATTA | SEQ ID NO: 558 |
| TTTTGTTTTACTGTGGGCATAAATTAA | SEQ ID NO: 559 |
| TTTGTTTTACTGTGGGCATAAATTAAT | SEQ ID NO: 560 |
| TTTTACTGTGGGCATAAATTAATTTTT | SEQ ID NO: 561 |
| TTTACTGTGGGCATAAATTAATTTTTC | SEQ ID NO: 562 |
| TTTTTCAGTTAAGTTTTGGAAGCTTAA | SEQ ID NO: 563 |
| TTTTCAGTTAAGTTTTGGAAGCTTAAA | SEQ ID NO: 564 |
| TTTAAGCTTCCAAAACTTAACTGAAAA | SEQ ID NO: 565 |
| TTTTCAGTTAAGTTTTGGAAGCTTAAAT | SEQ ID NO: 566 |
| TTTTGGAAGCTTAAATAACTCTCCAAA | SEQ ID NO: 567 |
| TTTGGAGAGTTATTTAAGCTTCCAAAA | SEQ ID NO: 568 |
| TTTGGAAGCTTAAATAACTCTCCAAAA | SEQ ID NO: 569 |
| TTTTGGAGAGTTATTTAAGCTTCCAAA | SEQ ID NO: 570 |
| TTTATGACTTTTGGAGAGTTATTTAAG | SEQ ID NO: 571 |
| TTTGGGCTCAACCAGTTACTGGCTTTA | SEQ ID NO: 572 |
| TTTGAATTTGGGCTCAACCAGTTACTG | SEQ ID NO: 573 |
| TTTCTAAGAAGAGGACAAGTATCAGAC | SEQ ID NO: 574 |
| TTTTCTAAGAAGAGGACAAGTATCAGA | SEQ ID NO: 575 |
| TTTGTGAGAGCATCACTGTAATCTTTT | SEQ ID NO: 576 |
| TTTTGTGAGAGCATCACTGTAATCTTT | SEQ ID NO: 577 |
| TTTGAGGGAAGGCGGCAAGATTTTGTG | SEQ ID NO: 578 |
| TTTAATATGTTCTTATTATTAGAAGCT | SEQ ID NO: 579 |
| TTTGCATCTGAGCTTCTAATAATAAGA | SEQ ID NO: 580 |
| TTTCATAACATTAAAAGCTAAGAGAGC | SEQ ID NO: 581 |

FIG. 17 cont.

| | |
|---|---|
| TTTTCATAACATTAAAAGCTAAGAGAG | SEQ ID NO: 582 |
| TTTTTCATAACATTAAAAGCTAAGAGA | SEQ ID NO: 583 |
| TTTTTTCATAACATTAAAAGCTAAGAG | SEQ ID NO: 584 |
| TTTTTTTCATAACATTAAAAGCTAAGA | SEQ ID NO: 585 |
| TTTTAATGTTATGAAAAAAATCAGGTC | SEQ ID NO: 586 |
| TTTAATGTTATGAAAAAAATCAGGTCT | SEQ ID NO: 587 |
| TTTCCTTAATGATAGGGTGTTTCTAGA | SEQ ID NO: 588 |
| TTTCTAGAGAGATATATCTGGTCAAGG | SEQ ID NO: 589 |
| TTTTAGTGATCATGTACCCTGAATATA | SEQ ID NO: 590 |
| TTTAGTGATCATGTACCCTGAATATAA | SEQ ID NO: 591 |
| TTTAAATACACTTATATTCAGGGTACA | SEQ ID NO: 592 |
| TTTTAAATACACTTATATTCAGGGTAC | SEQ ID NO: 593 |
| TTTAAAAGAATTTTATACACATATATT | SEQ ID NO: 594 |
| TTTTATACACATATATTTAGTGTCAAT | SEQ ID NO: 595 |
| TTTATACACATATATTTAGTGTCAATC | SEQ ID NO: 596 |
| TTTAGTGTCAATCTGTATATTTAGTAG | SEQ ID NO: 597 |
| TTTAGTAGCACTAACACTTCTCTTCAT | SEQ ID NO: 598 |
| TTTCATTGAAAATGAAGAGAAGTGTTA | SEQ ID NO: 599 |
| TTTTCATTGAAAATGAAGAGAAGTGTT | SEQ ID NO: 600 |
| TTTTTCATTGAAAATGAAGAGAAGTGT | SEQ ID NO: 601 |
| TTTTCAATGAAAAATATAGAGTTTATA | SEQ ID NO: 602 |
| TTTCAATGAAAAATATAGAGTTTATAA | SEQ ID NO: 603 |
| TTTATAATATTTTCTTCCCACTTCCCC | SEQ ID NO: 604 |
| TTTTCTTCCCACTTCCCCATGGATGGT | SEQ ID NO: 605 |
| TTTCTTCCCACTTCCCCATGGATGGTC | SEQ ID NO: 606 |
| TTTCCAAAATGAGAGGCATGACTAGAC | SEQ ID NO: 607 |
| TTTCAGAAACAGTACTTTCCAAAATGA | SEQ ID NO: 608 |
| TTTTGGAAAGTACTGTTTCTGAAACAT | SEQ ID NO: 609 |
| TTTGGAAAGTACTGTTTCTGAAACATT | SEQ ID NO: 610 |
| TTTCTGAAACATTAGGCAATATATTCC | SEQ ID NO: 611 |
| TTTACAGCAATCACCTGTGGATGCTAA | SEQ ID NO: 612 |
| TTTAATTAGCATCCACAGGTGATTGCT | SEQ ID NO: 613 |
| TTTTAATTAGCATCCACAGGTGATTGC | SEQ ID NO: 614 |
| TTTGCGTTTTAATTAGCATCCACAGGT | SEQ ID NO: 615 |
| TTTCCATTATGATCAAATGGAGTAATG | SEQ ID NO: 616 |
| TTTGATCATAATGGAAAGTATGTTCTG | SEQ ID NO: 617 |
| TTTGCCATAGTCCTCACCTATCCCTGT | SEQ ID NO: 618 |
| TTTTATCGGGTCCAACTCAACCATTTA | SEQ ID NO: 619 |
| TTTATCGGGTCCAACTCAACCATTTAA | SEQ ID NO: 620 |
| TTTAAGGTATTTGCCAGCTCTTGTATG | SEQ ID NO: 621 |
| TTTGCCAGCTCTTGTATGCATTTAGGT | SEQ ID NO: 622 |

FIG. 17 cont.

| | |
|---|---|
| TTTAGGTTTTGTTTCTTTGTTTTTTAG | SEQ ID NO: 623 |
| TTTTGTTTCTTTGTTTTTTAGCTCATG | SEQ ID NO: 624 |
| TTTGTTTCTTTGTTTTTTAGCTCATGA | SEQ ID NO: 625 |
| TTTCATGAGCTAAAAAACAAAGAAACA | SEQ ID NO: 626 |
| TTTCTTTGTTTTTTAGCTCATGAAATT | SEQ ID NO: 627 |
| TTTGTTTTTTAGCTCATGAAATTAGGT | SEQ ID NO: 628 |
| TTTTTTAGCTCATGAAATTAGGTACAA | SEQ ID NO: 629 |
| TTTTTAGCTCATGAAATTAGGTACAAA | SEQ ID NO: 630 |
| TTTGTACCTAATTTCATGAGCTAAAAA | SEQ ID NO: 631 |
| TTTTAGCTCATGAAATTAGGTACAAAG | SEQ ID NO: 632 |
| TTTAGCTCATGAAATTAGGTACAAAGT | SEQ ID NO: 633 |
| TTTATATGCCAGACCCCTCTCTGACTT | SEQ ID NO: 634 |
| TTTTATATGCCAGACCCCTCTCTGACT | SEQ ID NO: 635 |
| TTTCTGCTGAGGTTTTATATGCCAGAC | SEQ ID NO: 636 |
| TTTATTTCTGCTGAGGTTTTATATGCC | SEQ ID NO: 637 |
| TTTTGTTGTTTGGTAAGAACATACCTT | SEQ ID NO: 638 |
| TTTGTTGTTTGGTAAGAACATACCTTG | SEQ ID NO: 639 |
| TTTGGTAAGAACATACCTTGGGTTGGT | SEQ ID NO: 640 |
| TTTGGGAGGCCAAGGCAGGCTGATCAC | SEQ ID NO: 641 |
| TTTCACCATGTTGGCCAGGCTGGTCTT | SEQ ID NO: 642 |
| TTTCAGTAGAGACGGGATTTCACCATG | SEQ ID NO: 643 |
| TTTTCAGTAGAGACGGGATTTCACCAT | SEQ ID NO: 644 |
| TTTGTATTTCAGTAGAGACGGGATTT | SEQ ID NO: 645 |
| TTTTGTATTTCAGTAGAGACGGGATT | SEQ ID NO: 646 |
| TTTTTGTATTTCAGTAGAGACGGGAT | SEQ ID NO: 647 |
| TTTGGGATGGAATCTCATTCCATTGCC | SEQ ID NO: 648 |
| TTTTGGGATGGAATCTCATTCCATTGC | SEQ ID NO: 649 |
| TTTTTGGGATGGAATCTCATTCCATTG | SEQ ID NO: 650 |
| TTTTTTGGGATGGAATCTCATTCCATT | SEQ ID NO: 651 |
| TTTATTTTTTGGGATGGAATCTCATTC | SEQ ID NO: 652 |
| TTTTATTTTTTGGGATGGAATCTCATT | SEQ ID NO: 653 |
| TTTTTATTTTTTGGGATGGAATCTCAT | SEQ ID NO: 654 |
| TTTTTTATTTTTTGGGATGGAATCTCA | SEQ ID NO: 655 |
| TTTTTTTATTTTTTGGGATGGAATCTC | SEQ ID NO: 656 |
| TTTATTTTTTTATTTTTTGGGATGGAA | SEQ ID NO: 657 |
| TTTTATTTTTTTATTTTTTGGGATGGA | SEQ ID NO: 658 |
| TTTTTATTTTTTTATTTTTTGGGATGG | SEQ ID NO: 659 |
| TTTTTTATTTTTTTATTTTTTGGGATG | SEQ ID NO: 660 |
| TTTTTTTATTTTTTTATTTTTTGGGAT | SEQ ID NO: 661 |
| TTTATTTTTTTATTTTTTATTTTTTG | SEQ ID NO: 662 |
| TTTCTAAACTGTATGAAGTGTCTAGTA | SEQ ID NO: 663 |

FIG. 17 cont.

| Sequence | SEQ ID |
|---|---|
| TTTTCTAAACTGTATGAAGTGTCTAGT | SEQ ID NO: 664 |
| TTTAGAAAATCAGATGGGTGTAGATCA | SEQ ID NO: 665 |
| TTTGGTTCCTGCTCCTGCCTTGATCTA | SEQ ID NO: 666 |
| TTTTGGTTCCTGCTCCTGCCTTGATCT | SEQ ID NO: 667 |
| TTTTTGGTTCCTGCTCCTGCCTTGATC | SEQ ID NO: 668 |
| TTTCTTTTGGTTCCTGCTCCTGCCTT | SEQ ID NO: 669 |
| TTTATGCCTTTCTTTTTGGTTCCTGCT | SEQ ID NO: 670 |
| TTTCTTATGTTTATGCCTTTCTTTTTG | SEQ ID NO: 671 |
| TTTTCTTATGTTTATGCCTTTCTTTTT | SEQ ID NO: 672 |
| TTTTTCTTATGTTTATGCCTTTCTTTT | SEQ ID NO: 673 |
| TTTTTTCTTATGTTTATGCCTTTCTTT | SEQ ID NO: 674 |
| TTTTTTTCTTATGTTTATGCCTTTCTT | SEQ ID NO: 675 |
| TTTTTTTTCTTATGTTTATGCCTTTCT | SEQ ID NO: 676 |
| TTTCCACCCCTTCCATTTTTTTTCTTA | SEQ ID NO: 677 |
| TTTGATGGGGCTATTATGAACTGAGA | SEQ ID NO: 678 |
| TTTCTCAGTTCATAATAGCCCCCATCA | SEQ ID NO: 679 |
| TTTCAAAGTTCATTTCTCAGTTCATAA | SEQ ID NO: 680 |
| TTTTCAAAGTTCATTTCTCAGTTCATA | SEQ ID NO: 681 |
| TTTGGCCCCAAGATACTTTTCAAAGTT | SEQ ID NO: 682 |
| TTTGAAAAGTATCTTGGGGCCAAATCA | SEQ ID NO: 683 |
| TTTCTCTGGAGGCTCTCAAGGACTTCT | SEQ ID NO: 684 |
| TTTAAGAGCCTTTCTCTGGAGGCTCTC | SEQ ID NO: 685 |
| TTTTAAGAGCCTTTCTCTGGAGGCTCT | SEQ ID NO: 686 |
| TTTTTAAGAGCCTTTCTCTGGAGGCTC | SEQ ID NO: 687 |
| TTTCTAGCAGTATCTTCTGTCACTGGA | SEQ ID NO: 688 |
| TTTCTAGCAGATTTCTAGCAGTATCTT | SEQ ID NO: 689 |
| TTTTCTAGCAGATTTCTAGCAGTATCT | SEQ ID NO: 690 |
| TTTTTCTAGCAGATTTCTAGCAGTATC | SEQ ID NO: 691 |
| TTTTTTCTAGCAGATTTCTAGCAGTAT | SEQ ID NO: 692 |
| TTTTTTTCTAGCAGATTTCTAGCAGTA | SEQ ID NO: 693 |
| TTTTTTTTCTAGCAGATTTCTAGCAGT | SEQ ID NO: 694 |
| TTTGTTTTTTTCTAGCAGATTTCTAG | SEQ ID NO: 695 |
| TTTTGTTTTTTTCTAGCAGATTTCTA | SEQ ID NO: 696 |
| TTTTTGTTTTTTTCTAGCAGATTTCT | SEQ ID NO: 697 |
| TTTTTTGTTTTTTTCTAGCAGATTTC | SEQ ID NO: 698 |
| TTTCCCTCATAATTCCTCTATACATGC | SEQ ID NO: 699 |
| TTTGAAGAATAAACCGTGACTTGGTAT | SEQ ID NO: 700 |
| TTTTGAAGAATAAACCGTGACTTGGTA | SEQ ID NO: 701 |
| TTTATTCTTCAAAATGGAGGTGGCTTG | SEQ ID NO: 702 |
| TTTCCACTCTGGCCAAATGAGCTTCCA | SEQ ID NO: 703 |
| TTTGGCCAGAGTGGAAATGGAATTGGG | SEQ ID NO: 704 |

FIG. 17 cont.

| | |
|---|---|
| TTTCTCCCAATTCCATTTCCACTCTGG | SEQ ID NO: 705 |
| TTTGGTCATCGATTTCTCCCAATTCCA | SEQ ID NO: 706 |
| TTTACATTTGGTCATCGATTTCTCCCA | SEQ ID NO: 707 |
| TTTCACTTGGGGCTAACTTGGTGTCAA | SEQ ID NO: 708 |
| TTTTCCCGATATTCCTCAGGTACTCCA | SEQ ID NO: 709 |
| TTTCCCGATATTCCTCAGGTACTCCAA | SEQ ID NO: 710 |
| TTTGGAGTACCTGAGGAATATCGGGAA | SEQ ID NO: 711 |
| TTTACTCACGTCATCCAGCAGAGAATG | SEQ ID NO: 712 |
| TTTCCATTCTCTGCTGGATGACGTGAG | SEQ ID NO: 713 |
| TTTGACTTTCCATTCTCTGCTGGATGA | SEQ ID NO: 714 |
| TTTCCTGAATTGCTATGTGTCTGGGTT | SEQ ID NO: 715 |
| TTTCATCCATCGACATTGAAGTTGAC | SEQ ID NO: 716 |
| TTTCAATTCTCTCCATTCTTCAGTA | SEQ ID NO: 717 |
| TTTTCAATTCTCTCTCCATTCTTCAGT | SEQ ID NO: 718 |
| TTTTTCAATTCTCTCTCCATTCTTCAG | SEQ ID NO: 719 |
| TTTCAGCAAGGACTGGTCTTTCTATCT | SEQ ID NO: 720 |
| TTTCTATCTCTTGTACTACACTGAATT | SEQ ID NO: 721 |
| TTTCAGTGGGGGTGAATTCAGTGTAGT | SEQ ID NO: 722 |
| TTTTCAGTGGGGGTGAATTCAGTGTAG | SEQ ID NO: 723 |
| TTTTTCAGTGGGGGTGAATTCAGTGTA | SEQ ID NO: 724 |
| TTTGTCACAGCCCAAGATAGTTAAGTG | SEQ ID NO: 725 |
| TTTCAGCAGCTTACAAAAGAATGTAAG | SEQ ID NO: 726 |
| TTTTGTAAGCTGCTGAAAGTTGTGTAT | SEQ ID NO: 727 |
| TTTGTAAGCTGCTGAAAGTTGTGTATG | SEQ ID NO: 728 |
| TTTATGATATGACTACTCATACACAAC | SEQ ID NO: 729 |
| TTTATATCAAAGCAGCTTTATGATATG | SEQ ID NO: 730 |
| TTTTATATCAAAGCAGCTTTATGATAT | SEQ ID NO: 731 |
| TTTTTATATCAAAGCAGCTTTATGATA | SEQ ID NO: 732 |
| TTTTTTATATCAAAGCAGCTTTATGAT | SEQ ID NO: 733 |
| TTTGATATAAAAAGGTCTATGGCCAT | SEQ ID NO: 734 |
| TTTATATCAGATGGGATGGGACTCATT | SEQ ID NO: 735 |
| TTTAAGAACATTCCCTGACAATCCCAA | SEQ ID NO: 736 |
| TTTCTGAACCAGTAGTTTCCCTGCAGT | SEQ ID NO: 737 |
| TTTCCCTGCAGTTGAGCAGGGAGCAGC | SEQ ID NO: 738 |
| TTTGTGCAAGTGCTGCTGCTGCTCCCT | SEQ ID NO: 739 |
| TTTTGTGGCAGCTTCAGGTATATTTAG | SEQ ID NO: 740 |
| TTTGTGGCAGCTTCAGGTATATTTAGC | SEQ ID NO: 741 |
| TTTAGCACTGAACGAACATCTCAAGAA | SEQ ID NO: 742 |
| TTTGTTTGTAAGTCCTGCTGTCCTAGC | SEQ ID NO: 743 |
| TTTGTAAGTCCTGCTGTCCTAGCATCC | SEQ ID NO: 744 |
| TTTCTGGCTGGATTGGTATCTGAGGCT | SEQ ID NO: 745 |

FIG. 17 cont.

| Sequence | SEQ ID NO |
|---|---|
| TTTAGAGCTACCCAGCAGGAACAAGCC | SEQ ID NO: 746 |
| TTTCTAACCATTTTAGACATTTGTTAG | SEQ ID NO: 747 |
| TTTTAGACATTTGTTAGTACATGGTAT | SEQ ID NO: 748 |
| TTTAGACATTTGTTAGTACATGGTATT | SEQ ID NO: 749 |
| TTTAAAATACCATGTACTAACAAATGT | SEQ ID NO: 750 |
| TTTTAAAATACCATGTACTAACAAATG | SEQ ID NO: 751 |
| TTTGTTAGTACATGGTATTTTAAAAGT | SEQ ID NO: 752 |
| TTTACTTTTAAAATACCATGTACTAAC | SEQ ID NO: 753 |
| TTTTACTTTTAAAATACCATGTACTAA | SEQ ID NO: 754 |
| TTTTAAAAGTAAAACTTAATGTCTTCC | SEQ ID NO: 755 |
| TTTAAAAGTAAAACTTAATGTCTTCCT | SEQ ID NO: 756 |
| TTTTTTTCTCCACTGTCTTTTTCATA | SEQ ID NO: 757 |
| TTTTTTTCTCCACTGTCTTTTTCATAG | SEQ ID NO: 758 |
| TTTTTTCTCCACTGTCTTTTTCATAGA | SEQ ID NO: 759 |
| TTTTTCTCCACTGTCTTTTTCATAGAT | SEQ ID NO: 760 |
| TTTTCTCCACTGTCTTTTTCATAGATC | SEQ ID NO: 761 |
| TTTCTCCACTGTCTTTTTCATAGATCG | SEQ ID NO: 762 |
| TTTTTCATAGATCGAGACATGTAAGCA | SEQ ID NO: 763 |
| TTTTCATAGATCGAGACATGTAAGCAG | SEQ ID NO: 764 |
| TTTCATAGATCGAGACATGTAAGCAGC | SEQ ID NO: 765 |
| TTTCTCAAGGTCAAAAACTTACCTCCA | SEQ ID NO: 766 |
| TTTTCTCAAGGTCAAAAACTTACCTCC | SEQ ID NO: 767 |
| TTTTTGACCTTGAGAAAATGTTTTTGT | SEQ ID NO: 768 |
| TTTTGACCTTGAGAAAATGTTTTTGTT | SEQ ID NO: 769 |
| TTTGACCTTGAGAAAATGTTTTTGTTT | SEQ ID NO: 770 |
| TTTTTGTTTCACTGTCCTGAGGACTAT | SEQ ID NO: 771 |
| TTTTGTTTCACTGTCCTGAGGACTATT | SEQ ID NO: 772 |
| TTTGTTTCACTGTCCTGAGGACTATTT | SEQ ID NO: 773 |
| TTTCACTGTCCTGAGGACTATTTATAG | SEQ ID NO: 774 |
| TTTATAGACAGCTCTAACATGATAACC | SEQ ID NO: 775 |
| TTTCCCTGCTAAAATGTTACTCTGTCA | SEQ ID NO: 776 |
| TTTTAGCAGGGAAAGAAGAATCCTACA | SEQ ID NO: 777 |
| TTTAGCAGGGAAAGAAGAATCCTACAG | SEQ ID NO: 778 |
| TTTGCCCTCTCTGTAGAGGGTCAGTAA | SEQ ID NO: 779 |
| TTTATCCTGCAATACCATACTGGCAGT | SEQ ID NO: 780 |
| TTTGATCTTTCTTCTGCCATTTCCACA | SEQ ID NO: 781 |
| TTTCTTCTGCCATTTCCACATTGGACA | SEQ ID NO: 782 |
| TTTCCACATTGGACATCTGCTGAGG | SEQ ID NO: 783 |
| TTTCTCTCCTCAGCAGAGATGTCCAAT | SEQ ID NO: 784 |
| TTTTCTCTCCTCAGCAGAGATGTCCAA | SEQ ID NO: 785 |
| TTTTCCTTTGTATAATGTTGTTTTATT | SEQ ID NO: 786 |

FIG. 17 cont.

| Sequence | SEQ ID |
|---|---|
| TTTCCTTTGTATAATGTTGTTTTATTC | SEQ ID NO: 787 |
| TTTGTATAATGTTGTTTTATTCTTCAG | SEQ ID NO: 788 |
| TTTTATTCTTCAGACAGAAGAGAGGAG | SEQ ID NO: 789 |
| TTTATTCTTCAGACAGAAGAGAGGAGT | SEQ ID NO: 790 |
| TTTGCCTCTTAGAGGTTCCCAGGCCAC | SEQ ID NO: 791 |
| TTTATCTCCTCTAGTGGCCTGGGAACC | SEQ ID NO: 792 |
| TTTCCCTTTATCTCCTCTAGTGGCCTG | SEQ ID NO: 793 |
| TTTGGACTCCAACTAAAGATGCAGAGA | SEQ ID NO: 794 |
| TTTAGTTGGAGTCCAAAGGCTTTTCAA | SEQ ID NO: 795 |
| TTTCATTGAAAAGCCTTTGGACTCCAA | SEQ ID NO: 796 |
| TTTTCAATGAAATTCTACTGCCCAGGG | SEQ ID NO: 797 |
| TTTCAATGAAATTCTACTGCCCAGGGT | SEQ ID NO: 798 |
| TTTCAGCATCAATGTACCCTGGGCAGT | SEQ ID NO: 799 |
| TTTGAATGGGGTTTCAGCATCAATGTA | SEQ ID NO: 800 |
| TTTGGGAGAGCATCAGGAAGGTGGATG | SEQ ID NO: 801 |
| TTTACTAACAGTGTGACTGGGCAGATC | SEQ ID NO: 802 |
| TTTCTCAGAACATGTCCCCGTCATTAA | SEQ ID NO: 803 |
| TTTGTGTAAGCATTTCTCAGAACATGT | SEQ ID NO: 804 |
| TTTGTAGTCTAGGAGCAATAGGCTATA | SEQ ID NO: 805 |
| TTTAGATACACAAATACTTACCATTGT | SEQ ID NO: 806 |
| TTTGTGTATCTAAACATAGAAGTTGCA | SEQ ID NO: 807 |
| TTTACTGCAACTTCTATGTTTAGATAC | SEQ ID NO: 808 |
| TTTTACTGCAACTTCTATGTTTAGATA | SEQ ID NO: 809 |
| TTTTTACTGCAACTTCTATGTTTAGAT | SEQ ID NO: 810 |
| TTTTAATCTTATGAGACCACTGTCATA | SEQ ID NO: 811 |
| TTTAATCTTATGAGACCACTGTCATAT | SEQ ID NO: 812 |
| TTTGGTCAATGATGGACTGTATATATG | SEQ ID NO: 813 |
| TTTTGGTCAATGATGGACTGTATATAT | SEQ ID NO: 814 |
| TTTTTTCTTCTAAGATTTTGGGAGCAC | SEQ ID NO: 815 |
| TTTTTCTTCTAAGATTTTGGGAGCACC | SEQ ID NO: 816 |
| TTTTCTTCTAAGATTTTGGGAGCACCA | SEQ ID NO: 817 |
| TTTCTTCTAAGATTTTGGGAGCACCAA | SEQ ID NO: 818 |
| TTTGGTGCTCCCAAAATCTTAGAAGAA | SEQ ID NO: 819 |
| TTTTGGGAGCACCAAAGGGATACACTA | SEQ ID NO: 820 |
| TTTGGGAGCACCAAAGGGATACACTAA | SEQ ID NO: 821 |
| TTTATAATGGGTTTGGAGAACTGTCTG | SEQ ID NO: 822 |
| TTTGGAGAACTGTCTGCAGCTACTTCT | SEQ ID NO: 823 |
| TTTAAAAGAAGTAGCTGCAGACAGTTC | SEQ ID NO: 824 |
| TTTTAAAAGAAGTAGCTGCAGACAGTT | SEQ ID NO: 825 |
| TTTTTAAAAGAAGTAGCTGCAGACAGT | SEQ ID NO: 826 |
| TTTTAAAAAGGTGATCTACACAGTAGA | SEQ ID NO: 827 |

FIG. 17 cont.

| | |
|---|---|
| TTTAAAAAGGTGATCTACACAGTAGAA | SEQ ID NO: 828 |
| TTTCTACTGTGTAGATCACCTTTTTAA | SEQ ID NO: 829 |
| TTTGGATTGCAGATCTCATTACCAAAC | SEQ ID NO: 830 |
| TTTGGTAATGAGATCTGCAATCCAAAT | SEQ ID NO: 831 |
| TTTATTTGGATTGCAGATCTCATTACC | SEQ ID NO: 832 |
| TTTTATTTGGATTGCAGATCTCATTAC | SEQ ID NO: 833 |
| TTTATTTTATTTGGATTGCAGATCTCA | SEQ ID NO: 834 |
| TTTTTCTTTTCTTTTCAGGTTTGAAGA | SEQ ID NO: 835 |
| TTTTCTTTTCTTTTCAGGTTTGAAGAT | SEQ ID NO: 836 |
| TTTCTTTTCTTTTCAGGTTTGAAGATG | SEQ ID NO: 837 |
| TTTTCTTTTCAGGTTTGAAGATGCCGC | SEQ ID NO: 838 |
| TTTCTTTTCAGGTTTGAAGATGCCGCA | SEQ ID NO: 839 |
| TTTTCAGGTTTGAAGATGCCGCATTTG | SEQ ID NO: 840 |
| TTTCAGGTTTGAAGATGCCGCATTTGG | SEQ ID NO: 841 |
| TTTGAAGATGCCGCATTTGGATTGGAT | SEQ ID NO: 842 |
| TTTGGAATTCATCCAATCCAAATGCGG | SEQ ID NO: 843 |
| TTTGGATTGGATGAATTCCAAATTCTG | SEQ ID NO: 844 |
| TTTTTAATATTGATATGCTTATACACT | SEQ ID NO: 845 |
| TTTTAATATTGATATGCTTATACACTT | SEQ ID NO: 846 |
| TTTAATATTGATATGCTTATACACTTA | SEQ ID NO: 847 |
| TTTGTGCATAAAGTGTAAGTGTATAAG | SEQ ID NO: 848 |
| TTTTGTGCATAAAGTGTAAGTGTATAA | SEQ ID NO: 849 |
| TTTATGCACAAAATGTAGGGTTATAAT | SEQ ID NO: 850 |
| TTTATAATTCTACTTTGAGTGCTGTCT | SEQ ID NO: 851 |
| TTTGAGTGCTGTCTCCATGTTTGATGT | SEQ ID NO: 852 |
| TTTGATGTATCTGAGCAGGTTGCTCCA | SEQ ID NO: 853 |
| TTTGAACTCTTCAATCTCTTGCACTCA | SEQ ID NO: 854 |
| TTTGAGTGCAAGAGATTGAAGAGTTCA | SEQ ID NO: 855 |
| TTTACATACTCTGCTTAGAATTTGGGG | SEQ ID NO: 856 |
| TTTCCCCAAATTCTAAGCAGAGTATG | SEQ ID NO: 857 |
| TTTTCCCCAAATTCTAAGCAGAGTAT | SEQ ID NO: 858 |
| TTTCTAAATTTTCCCCAAATTCTAAG | SEQ ID NO: 859 |
| TTTGGGGAAAATTTAGAAATATAATT | SEQ ID NO: 860 |
| TTTAGAAATATAATTGACAGGATTATT | SEQ ID NO: 861 |
| TTTCCAATAATCCTGTCAATTATATTT | SEQ ID NO: 862 |
| TTTCATTCATTATAACAAATTTCCAAT | SEQ ID NO: 863 |
| TTTGTTATAATGAATGAAACATTTTGT | SEQ ID NO: 864 |
| TTTTGTCATATAAGATTCATATTTACT | SEQ ID NO: 865 |
| TTTGTCATATAAGATTCATATTTACTT | SEQ ID NO: 866 |
| TTTATCAAATGTATAAGAAGTAAATAT | SEQ ID NO: 867 |
| TTTACTTCTTATACATTTGATAAAGTA | SEQ ID NO: 868 |

FIG. 17 cont.

| | |
|---|---|
| TTTGATAAAGTAAGGCATGGTTGTGGT | SEQ ID NO: 869 |
| TTTAACTTGTGGAACAAAAATAAACCA | SEQ ID NO: 870 |
| TTTATTTTTGTTCCACAAGTTAAATAA | SEQ ID NO: 871 |
| TTTATTTAACTTGTGGAACAAAAATAA | SEQ ID NO: 872 |
| TTTTTGTTCCACAAGTTAAATAAATCA | SEQ ID NO: 873 |
| TTTTGTTCCACAAGTTAAATAAATCAT | SEQ ID NO: 874 |
| TTTGTTCCACAAGTTAAATAAATCATA | SEQ ID NO: 875 |
| TTTATGATTTATTTAACTTGTGGAACA | SEQ ID NO: 876 |
| TTTTATGATTTATTTAACTTGTGGAAC | SEQ ID NO: 877 |
| TTTGAAAATAAAGGGGTAATAGTGGGA | SEQ ID NO: 878 |
| TTTCCCTGTTTGAAAATAAAGGGGTAA | SEQ ID NO: 879 |
| TTTATTTTCAAACAGGGAAACAGTCTT | SEQ ID NO: 880 |

FIG. 17 cont.

CELLS LACKING B2M SURFACE EXPRESSION AND METHODS FOR ALLOGENEIC ADMINISTRATION OF SUCH CELLS

CROSS-REFERENCE TO RELATED APPLICATIONS

This application is a national stage filing under 35 U.S.C. 371 of International Application No. PCT/US2015/059621, filed Nov. 6, 2015, which claims the benefit of U.S. Provisional Application No. 62/076,424, filed on Nov. 6, 2014, the contents of which are hereby incorporated by reference in its entirety. International Application PCT/US2015/059621 was published under PCT Article 21(2) in English.

GOVERNMENT SUPPORT

This invention was made with government support under 5R01AI053330-09, R01-DK097768 and U01HL100408 awarded by the National Institutes of Health. The government has certain rights in the invention.

BACKGROUND OF THE INVENTION

Genome editing applications have increased in frequency as a result of the efficacy and ease of use of recent tools, e.g., CRISPR and TALEN systems. However, genome editing in clinically relevant human somatic cells remains a challenge, for example, due to unwanted host immune responses to allogeneic transplantation of such cells. Accordingly, there exists a need for cells suitable for allogeneic transplantation that eliminate or reduce the likelihood of triggering unwanted recipient immune responses to allogeneic transplants of such cells.

SUMMARY OF THE INVENTION

Work described herein demonstrates targeting of clinically relevant genes, e.g., B2M and CCR5, in primary human CD4+ T cells and CD34+ hematopoietic stem and progenitor cells (HSPCs) using genome editing tools, such as a CRISPR and/or TALEN system. In a CRISPR/Cas system the Cas protein may be, for example, Cas9 or Cpf1. Work described herein demonstrates efficient ablation of genes in HSPCs with minimal off-target mutagenesis, which has broad applicability for hematopoietic cell-based therapy. One particular aspect of work described herein is the creation of cells suitable for transplantation that eliminate or reduce the likelihood of triggering unwanted recipient immune responses to allogeneic transplants of such cells.

Accordingly, in some aspects, the invention provides a primary human cell or population of primary human cells comprising a genome in which the β2-microglobulin (B2M) gene on chromosome 15 has been edited to delete a contiguous stretch of genomic DNA comprising base pairs 5109 to 7331 (SEQ ID NO: 1; NCBI Reference Sequence: NG_012920.1), thereby eliminating surface expression of MHC Class I molecules in the cell or population of cells.

In some aspects, the invention provides a primary human cell or population of primary human cells comprising a genome in which the β2-microglobulin (B2M) gene on chromosome 15 has been edited to delete a contiguous stretch of genomic DNA, thereby eliminating surface expression of MHC Class I molecules in the cell or population of cells, wherein the contiguous stretch of genomic DNA has been deleted by contacting the cell or population of human cells with a Cas protein or a nucleic acid encoding the Cas protein and a pair of ribonucleic acids targeting SEQ ID NO: 16 and SEQ ID NO: 21.

In some embodiments, the cell or population of cells are selected from the group consisting of a stem cell, a pluripotent cell, a progenitor cells, a hematopoietic stem and/or progenitor cell, a CD34+ mobilized peripheral blood cell, a CD34+ cord blood cell, a CD34+ bone marrow cell, a CD34+CD38-Lineage-CD90+CD45RA– cell, and a CD34+ hematopoietic stem and/or progenitor cell; a CD4+ T cell, a hepatocyte, a somatic cell, and a non-transformed cell.

In some embodiments, the cell or cells is obtained from a subject suffering from, being treated for, diagnosed with, at risk of developing, or suspected of having, a disorder selected from the group consisting of a genetic disorder, an infection, and cancer. In some embodiments, the disorder comprises HIV or AIDs. In some embodiments, the cell or population of cells comprises a genome in which one or more additional genes have been edited to eliminate expression.

In some aspects, the invention provides a method for allogeneic administration of cells to a subject in need of such cells, the method comprising: (a) contacting a population of primary cells obtained from a first subject ex vivo with a Cas protein or a nucleic acid encoding a Cas protein and a pair of ribonucleic acids targeting SEQ ID NO: 16 and SEQ ID NO: 21, thereby editing the genome of at least 25% of the primary cells in the population to delete a contiguous stretch of genomic DNA comprising base pairs 5109 to 7331 (SEQ ID NO: 1) in the B2M gene on chromosome 15, wherein the genomically edited cells lack surface expression of MHC Class I protein; and (b) administering the genomically edited cells to a second subject in need of such cells.

In some embodiments, prior to the step of administering, the population of cells is sorted for genomically edited cells. In some embodiments, prior to the step of administering, the population of cells is expanded. In some embodiments, the population of primary cells are selected from the group consisting of a stem cell, a pluripotent cell, a progenitor cells, a hematopoietic stem and/or progenitor cells, a CD34+ cell, a CD34+ mobilized peripheral blood cell, a CD34+ cord blood cell, a CD34+ bone marrow cell, a CD34+CD38-Lineage-CD90+CD45RA– cell, a CD34+ hematopoietic stem and/or progenitor cell, a CD4+ T cell, a hepatocyte, a somatic cell, and a non-transformed cell. In some embodiments, the second subject is suffering from, being treated for, diagnosed with, at risk of developing, or suspected of having, a disorder selected from the group consisting of a genetic disorder, an infection, and cancer. In some embodiments, the disorder comprises HIV or AIDs. In some embodiments, the method includes, prior to the step of administering, editing the genome of the genomically modified cells to eliminate or reduce expression of one or more additional genes.

In some embodiments, the invention provides a composition comprising a chimeric nucleic acid, the chimeric nucleic acid comprising: (a) a nucleic acid sequence encoding a Cas protein; and at least two ribonucleic acids each targeting a different sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23. In some embodiments, the at least two ribonucleic acids comprise a first ribonucleic acid targeting SEQ ID NO: 16, and a second ribonucleic acid targeting SEQ ID NO: 21.

In some embodiments, the composition comprising a nucleic acid sequence encoding a detectable marker. In some embodiments, the Cas protein comprises a Cas9 protein or a functional portion thereof. In some embodiments, the composition includes a promoter optimized for increased expression in human cells operably linked to the chimeric nucleic acid, wherein the promoter is selected from the group consisting of a Cytomegalovirus (CMV) early enhancer element and a chicken beta-actin promoter, a chicken beta-actin promoter, an elongation factor-1 alpha promoter, and a ubiquitin promoter. In some embodiments, the chimeric nucleic acid comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiment, the nucleic acid encoding Cas protein comprises a messenger RNA (mRNA) encoding Cas9 protein. In some embodiments, the mRNA comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some aspects, the invention provides a method for altering a target B2M polynucleotide sequence in a cell comprising contacting the B2M polynucleotide sequence with a clustered regularly interspaced short palindromic repeats-associated (Cas) protein and from one to two ribonucleic acids, wherein the ribonucleic acids direct Cas protein to and hybridize to a target motif of the target B2M polynucleotide sequence, wherein the target B2M polynucleotide sequence is cleaved, and wherein at least one of the one to two ribonucleic acids target a sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23.

In some embodiments, each of the one to two ribonucleic acids target a sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23.

In some aspects, the invention provides a method for treating or preventing a disorder associated with expression of a polynucleotide sequence in a subject, the method comprising: (a) altering a target polynucleotide sequence associated with the disorder in a cell ex vivo by contacting the polynucleotide sequence with a clustered regularly interspaced short palindromic repeats-associated (Cas) protein and from one to two ribonucleic acids, wherein the ribonucleic acids direct Cas protein to and hybridize to a target motif of the target polynucleotide sequence associated with the disorder, wherein the target polynucleotide sequence associated with the disorder is cleaved; (b) altering a target B2M polynucleotide sequence in the cell ex vivo by contacting the target B2M polynucleotide sequence with a clustered regularly interspaced short palindromic repeats-associated (Cas) protein and two ribonucleic acids targeting a sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23; and (c) introducing the cell into the subject, thereby treating or preventing a disorder associated with expression of the polynucleotide sequence.

In some aspects, the present invention provides a primary human cell or population of primary human cells comprising a genome in which the β2-microglobulin (B2M) gene on chromosome 15 has been edited to delete a contiguous stretch of genomic DNA comprising base pairs 5109 to 7331 (SEQ ID NO: 1; *NCBI Reference Sequence*: NG_012920.1), thereby eliminating surface expression of MHC Class I protein in the cell or population of cells. In some embodiments, the contiguous stretch of genomic DNA has been deleted by contacting the cell or population of human cells with a Cas protein or a nucleic acid encoding the Cas protein and a pair of ribonucleic acids targeting SEQ ID NO: 16 and SEQ ID NO: 21.

In some aspects, the invention provides a primary human cell or population of primary human cells comprising a genome in which the β2-microglobulin (B2M) gene on chromosome 15 has been edited to delete a contiguous stretch of genomic DNA, thereby eliminating surface expression of MHC Class I molecules in the cell or population of cells, wherein the contiguous stretch of genomic DNA has been deleted by contacting the cell or population of human cells with a Cas protein or a nucleic acid encoding the Cas protein and a pair of ribonucleic acids targeting SEQ ID NO: 16 and SEQ ID NO: 21.

In some embodiments, the cell or population of cells are selected from the group consisting of a stem cell, a pluripotent cell, a progenitor cells, a hematopoietic stem and/or progenitor cell, a CD34+ cell selected from the group consisting of a CD34+ mobilized peripheral blood cell, a CD34+ cord blood cell, a CD34+ bone marrow cell, a CD34+CD38-Lineage-CD90+CD45RA− cell, and a CD34+ hematopoietic stem and/or progenitor cell; a CD4+ T cell, a hepatocyte, a somatic cell, and a non-transformed cell.

In some embodiments, the cells is obtained from a subject suffering from, being treated for, diagnosed with, at risk of developing, or suspected of having, a disorder selected from the group consisting of a genetic disorder, an infection, and cancer.

In some embodiments, the disorder comprises HIV or AIDs.

In some embodiments, the cell or population of cells comprises a genome in which the one or more additional genes have been edited to eliminate or reduce their expression.

In some embodiments, the cell or population of cells comprises a genome in which the CCR5 and/or CXCR4 genes have been edited to eliminate CCR5 and/or CXCR4 surface expression.

In some aspects, the present invention provides a method for allogeneic administration of cells to a subject in need of such cells, the method comprising: (a) contacting a population of primary cells obtained from a first subject ex vivo with a Cas protein or a nucleic acid encoding a Cas protein and a pair of ribonucleic acids targeting SEQ ID NO: 16 and SEQ ID NO: 21, thereby editing the genome of at least 25% of the primary cells in the population to delete a contiguous stretch of genomic DNA comprising base pairs 5109 to 7331 (SEQ ID NO: 1) in the B2M gene on chromosome 15, wherein the genomically edited cells lack surface expression of MHC Class I protein; and (b) administering the genomically edited cells to a second subject in need of such cells.

In some embodiments, prior to step of administering, the population of cells is sorted for genomically edited cells. In some embodiments, prior to the step of administering, the population of cells is expanded. In some embodiments, the population of primary cells obtained from the first subject are selected from the group consisting of a stem cell, a pluripotent cell, a progenitor cells, a hematopoietic stem and/or progenitor cells, a CD34+ cell, a CD34+ mobilized peripheral blood cell, a CD34+ cord blood cell, a CD34+ bone marrow cell, a CD34+CD38-Lineage-CD90+CD45RA− cell, a CD34+ hematopoietic stem and/or progenitor cell, a CD4+ T cell, a hepatocyte, a somatic cell, and a non-transformed cell.

In some embodiments, the second subject is suffering from, being treated for, diagnosed with, at risk of developing, or suspected of having, a disorder selected from the group consisting of a genetic disorder, an infection, and cancer. In some embodiments, the disorder comprises HIV or AIDs.

In some embodiments, the method comprises prior to the step of administering, contacting the genomically modified cells with Cas protein and one or more guide RNA sequences targeting the CCR5 and/or CXCR4 genes, thereby editing the genome of the genomically modified cells to eliminate or reduce surface expression of CCR5 and/or CXCR4.

In some aspects, the present invention provides a composition comprising a chimeric nucleic acid, the chimeric nucleic acid comprising: (a) a nucleic acid sequence encoding a Cas protein; (b) a first ribonucleic acid targeting SEQ ID NO: 16; and (c) a second ribonucleic acid targeting SEQ ID NO:21.

In some embodiments, the composition includes a nucleic acid sequence encoding a detectable marker (e.g., a fluorescent protein, e.g., GFP). In some embodiments, the Cas protein comprises a Cas9 protein or a functional portion thereof.

In some embodiments, the composition comprises a promoter optimized for increased expression in human cells operably linked to the chimeric nucleic acid, wherein the promoter is selected from the group consisting of a Cytomegalovirus (CMV) early enhancer element and a chicken beta-actin promoter, a chicken beta-actin promoter, an elongation factor-1 alpha promoter, and a ubiquitin promoter. In some embodiments, the chimeric nucleic acid comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiments, the nucleic acid encoding Cas protein comprises a messenger RNA (mRNA) encoding Cas9 protein. In some embodiments, the mRNA comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some aspects, the invention provides a primary human cell or population of primary human cells comprising a genome in which the β2-microglobulin (B2M) gene on chromosome 15 has been edited to delete a contiguous stretch of genomic DNA, thereby eliminating surface expression of MHC Class I molecules in the cell or population of cells, wherein the contiguous stretch of genomic DNA has been deleted by contacting the cell or population of human cells with a Cas protein or a nucleic acid encoding the Cas protein and a ribonucleic acid targeting a sequence selected from the group consisting of SEQ ID NOs: 419-880.

In some embodiments, the cell or population of cells are selected from the group consisting of a stem cell, a pluripotent cell, a progenitor cells, a hematopoietic stem and/or progenitor cell, a CD34+ mobilized peripheral blood cell, a CD34+ cord blood cell, a CD34+ bone marrow cell, a CD34+CD38-Lineage-CD90+CD45RA− cell, and a CD34+ hematopoietic stem and/or progenitor cell; a CD4+ T cell, a hepatocyte, a somatic cell, and a non-transformed cell.

In some embodiments, the cell or cells is obtained from a subject suffering from, being treated for, diagnosed with, at risk of developing, or suspected of having, a disorder selected from the group consisting of a genetic disorder, an infection, and cancer. In some embodiments, the disorder comprises HIV or AIDs. In some embodiments, the cell or population of cells comprises a genome in which one or more additional genes have been edited to eliminate expression.

In some aspects, the invention provides a method for allogeneic administration of cells to a subject in need of such cells, the method comprising: (a) contacting a population of primary cells obtained from a first subject ex vivo with a Cas protein or a nucleic acid encoding a Cas protein and a ribonucleic acid targeting a sequence selected from the group consisting of SEQ ID NOs: 419-880, thereby editing the genome of at least 25% of the primary cells in the population to delete a contiguous stretch of genomic DNA comprising base pairs 5109 to 7331 (SEQ ID NO: 1) in the B2M gene on chromosome 15, wherein the genomically edited cells lack surface expression of MHC Class I protein; and (b) administering the genomically edited cells to a second subject in need of such cells.

In some embodiments, prior to the step of administering, the population of cells is sorted for genomically edited cells. In some embodiments, prior to the step of administering, the population of cells is expanded. In some embodiments, the population of primary cells are selected from the group consisting of a stem cell, a pluripotent cell, a progenitor cells, a hematopoietic stem and/or progenitor cells, a CD34+ cell, a CD34+ mobilized peripheral blood cell, a CD34+ cord blood cell, a CD34+ bone marrow cell, a CD34+CD38-Lineage-CD90+CD45RA− cell, a CD34+ hematopoietic stem and/or progenitor cell, a CD4+ T cell, a hepatocyte, a somatic cell, and a non-transformed cell. In some embodiments, the second subject is suffering from, being treated for, diagnosed with, at risk of developing, or suspected of having, a disorder selected from the group consisting of a genetic disorder, an infection, and cancer. In some embodiments, the disorder comprises HIV or AIDs. In some embodiments, the method includes, prior to the step of administering, editing the genome of the genomically modified cells to eliminate or reduce expression of one or more additional genes.

In some embodiments, the invention provides a composition comprising a chimeric nucleic acid, the chimeric nucleic acid comprising: (a) a nucleic acid sequence encoding a Cas protein; and at least one ribonucleic acid targeting a sequence selected from the group consisting of SEQ ID NOs: 419-880.

In some embodiments, the composition comprising a nucleic acid sequence encoding a detectable marker. In some embodiments, the Cas protein comprises a Cpf1 protein or a functional portion thereof. In some embodiments, the composition includes a promoter optimized for increased expression in human cells operably linked to the chimeric nucleic acid, wherein the promoter is selected from the group consisting of a Cytomegalovirus (CMV) early enhancer element and a chicken beta-actin promoter, a chicken beta-actin promoter, an elongation factor-1 alpha promoter, and a ubiquitin promoter. In some embodiments, the chimeric nucleic acid comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiment, the nucleic acid encoding Cas protein comprises a messenger RNA (mRNA) encoding Cpf1 protein. In some embodiments, the mRNA comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some aspects, the invention provides a method for altering a target B2M polynucleotide sequence in a cell comprising contacting the B2M polynucleotide sequence with a clustered regularly interspaced short palindromic repeats-associated (Cas) protein and at least one ribonucleic acid, wherein the ribonucleic acid directs Cas protein to and hybridize to a target motif of the target B2M polynucleotide sequence, wherein the target B2M polynucleotide sequence is cleaved, and wherein the at least one ribonucleic acid targets a sequence selected from the group consisting of SEQ ID NOs: 419-880.

In some aspects, the invention provides a method for treating or preventing a disorder associated with expression of a polynucleotide sequence in a subject, the method comprising: (a) altering a target polynucleotide sequence associated with the disorder in a cell ex vivo by contacting the polynucleotide sequence with a clustered regularly interspaced short palindromic repeats-associated (Cas) protein and at least one ribonucleic acid, wherein the ribonucleic acid directs Cas protein to and hybridizes to a target motif of the target polynucleotide sequence associated with the disorder, wherein the target polynucleotide sequence associated with the disorder is cleaved; (b) altering a target B2M polynucleotide sequence in the cell ex vivo by contacting the target B2M polynucleotide sequence with a clustered regularly interspaced short palindromic repeats-associated (Cas) protein and at least one ribonucleic acid targeting a sequence selected from the group consisting of SEQ ID NOs: 419-880; and (c) introducing the cell into the subject, thereby treating or preventing a disorder associated with expression of the polynucleotide sequence.

In some aspects, the present invention provides a primary human cell or population of primary human cells comprising a genome in which the β2-microglobulin (B2M) gene on chromosome 15 has been edited to delete a contiguous stretch of genomic DNA comprising base pairs 5109 to 7331 (SEQ ID NO: 1; NCBI Reference Sequence: NG_012920.1), thereby eliminating surface expression of MHC Class I protein in the cell or population of cells. In some embodiments, the contiguous stretch of genomic DNA has been deleted by contacting the cell or population of human cells with a Cas protein or a nucleic acid encoding the Cas protein and a ribonucleic acid targeting a sequence selected from the group consisting of SEQ ID NOs: 419-880.

In some aspects, the invention provides a primary human cell or population of primary human cells comprising a genome in which the β2-microglobulin (B2M) gene on chromosome 15 has been edited to delete a contiguous stretch of genomic DNA, thereby eliminating surface expression of MHC Class I molecules in the cell or population of cells, wherein the contiguous stretch of genomic DNA has been deleted by contacting the cell or population of human cells with a Cas protein or a nucleic acid encoding the Cas protein and a ribonucleic acid targeting a sequence selected from the group consisting of SEQ ID NOs: 419-880.

In some embodiments, the cell or population of cells are selected from the group consisting of a stem cell, a pluripotent cell, a progenitor cells, a hematopoietic stem and/or progenitor cell, a CD34+ cell selected from the group consisting of a CD34+ mobilized peripheral blood cell, a CD34+ cord blood cell, a CD34+ bone marrow cell, a CD34+CD38-Lineage-CD90+CD45RA− cell, and a CD34+ hematopoietic stem and/or progenitor cell; a CD4+ T cell, a hepatocyte, a somatic cell, and a non-transformed cell.

In some embodiments, the cells is obtained from a subject suffering from, being treated for, diagnosed with, at risk of developing, or suspected of having, a disorder selected from the group consisting of a genetic disorder, an infection, and cancer.

In some embodiments, the disorder comprises HIV or AIDs.

In some embodiments, the cell or population of cells comprises a genome in which the one or more additional genes have been edited to eliminate or reduce their expression.

In some embodiments, the cell or population of cells comprises a genome in which the CCR5 and/or CXCR4 genes have been edited to eliminate CCR5 and/or CXCR4 surface expression.

In some aspects, the present invention provides a method for allogeneic administration of cells to a subject in need of such cells, the method comprising: (a) contacting a population of primary cells obtained from a first subject ex vivo with a Cas protein or a nucleic acid encoding a Cas protein and a ribonucleic acid targeting a sequence selected from the group consisting of SEQ ID NOs: 419-880, thereby editing the genome of at least 25% of the primary cells in the population to delete a contiguous stretch of genomic DNA comprising base pairs 5109 to 7331 (SEQ ID NO: 1) in the B2M gene on chromosome 15, wherein the genomically edited cells lack surface expression of MHC Class I protein; and (b) administering the genomically edited cells to a second subject in need of such cells.

In some embodiments, prior to step of administering, the population of cells is sorted for genomically edited cells. In some embodiments, prior to the step of administering, the population of cells is expanded. In some embodiments, the population of primary cells obtained from the first subject are selected from the group consisting of a stem cell, a pluripotent cell, a progenitor cells, a hematopoietic stem and/or progenitor cells, a CD34+ cell, a CD34+ mobilized peripheral blood cell, a CD34+ cord blood cell, a CD34+ bone marrow cell, a CD34+CD38-Lineage-CD90+ CD45RA− cell, a CD34+ hematopoietic stem and/or progenitor cell, a CD4+ T cell, a hepatocyte, a somatic cell, and a non-transformed cell.

In some embodiments, the second subject is suffering from, being treated for, diagnosed with, at risk of developing, or suspected of having, a disorder selected from the group consisting of a genetic disorder, an infection, and cancer. In some embodiments, the disorder comprises HIV or AIDs.

In some embodiments, the method comprises prior to the step of administering, contacting the genomically modified cells with Cas protein and one or more guide RNA sequences targeting the CCR5 and/or CXCR4 genes, thereby editing the genome of the genomically modified cells to eliminate or reduce surface expression of CCR5 and/or CXCR4.

In some aspects, the present invention provides a composition comprising a chimeric nucleic acid, the chimeric nucleic acid comprising: (a) a nucleic acid sequence encoding a Cas protein; and (b) a ribonucleic acid targeting a sequence selected from the group consisting of SEQ ID NOs: 419-880.

In some embodiments, the composition includes a nucleic acid sequence encoding a detectable marker (e.g., a fluorescent protein, e.g., GFP). In some embodiments, the Cas protein comprises a Cpf1 protein or a functional portion thereof.

In some embodiments, the composition comprises a promoter optimized for increased expression in human cells operably linked to the chimeric nucleic acid, wherein the promoter is selected from the group consisting of a Cytomegalovirus (CMV) early enhancer element and a chicken beta-actin promoter, a chicken beta-actin promoter, an elongation factor-1 alpha promoter, and a ubiquitin promoter. In some embodiments, the chimeric nucleic acid comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiments, the nucleic acid encoding Cas protein comprises a messenger RNA (mRNA) encoding Cas9 protein. In some embodiments, the mRNA comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some aspects, the invention provides a method for altering a target B2M polynucleotide sequence in a cell comprising contacting the B2M polynucleotide sequence with a clustered regularly interspaced short palindromic repeats-associated (Cas) protein and from one to two ribonucleic acids, wherein the ribonucleic acids direct Cas protein to and hybridize to a target motif of the target B2M polynucleotide sequence, wherein the target B2M polynucleotide sequence is cleaved, and wherein at least one of the one to two ribonucleic acids target a sequence selected from the group consisting of SEQ ID NOs: 881-2609.

In some embodiments, each of the one to two ribonucleic acids target a sequence selected from the group consisting of SEQ ID NOs: 881-2609.

In some aspects, the invention provides a method for treating or preventing a disorder associated with expression of a polynucleotide sequence in a subject, the method comprising: (a) altering a target polynucleotide sequence associated with the disorder in a cell ex vivo by contacting the polynucleotide sequence with a clustered regularly interspaced short palindromic repeats-associated (Cas) protein and from one to two ribonucleic acids, wherein the ribonucleic acids direct Cas protein to and hybridize to a target motif of the target polynucleotide sequence associated with the disorder, wherein the target polynucleotide sequence associated with the disorder is cleaved; (b) altering a target B2M polynucleotide sequence in the cell ex vivo by contacting the target B2M polynucleotide sequence with a clustered regularly interspaced short palindromic repeats-associated (Cas) protein and two ribonucleic acids targeting a sequence selected from the group consisting of SEQ ID NOs: 881-2609; and (c) introducing the cell into the subject, thereby treating or preventing a disorder associated with expression of the polynucleotide sequence.

BRIEF DESCRIPTION OF THE DRAWINGS

FIG. 1 shows an exemplary 2.2 kb stretch of contiguous genomic DNA deleted from the human B2M gene that results in ablation of major histocompatibility complex (MHC) class I molecule surface expression in cells edited using the B2M gRNAs of the present disclosure.

FIG. 2 shows exemplary gRNA target sequences useful for targeting the human CCR5 gene using Cas9.

FIG. 3 shows exemplary gRNA target sequences useful for targeting the human B2M gene using Cas9.

FIG. 4 shows an exemplary amino acid sequence of a Cas protein. Yellow highlights indicate Ruv-C-like domain. Underlining indicates HNH nuclease domain.

FIGS. 5A, 5B, 5C, 5D, 5E, 5F, 5G and 5H demonstrate targeting clinically relevant loci in human cells using CRISPR/Cas9. FIG. 5A is a schematic of gRNAs targeting B2M. FIG. 5B is a histogram of B2M surface expression in HEK293T cells. FIG. 5C shows B2M deletion efficiency with various gRNAs in HEK293T cells; n=3 (mean±SEM). FIG. 5D is a schematic of gRNAs targeting CCR5. Orange and green arrows represent primer pairs used to amplify the region for analysis. FIG. 5E shows results of Surveyor assays of each gRNA targeting CCR5 in K562 cells. % InDels is indicated under each guide. FIG. 5F illustrates B2M deletion efficiency of selected gRNAs in primary CD4+ T cells in comparison to 293T cells; n=6 (mean±SEM). FIG. 5G shows results of surveyor assay of crCCR5_A and crCCR5_B targeting CCR5 in K562 cells and HSPCs. FIG. 5H illustrates clonal deletion efficiency of crCCR5_A and crCCR5_B targeting of CCR5 in HSPCs (n=2) as determined by Sanger sequencing. (Note: crB2M_14 is not depicted in panel A schematic, as it is located 20 Kb downstream of coding sequence.). See also FIG. 6.

FIG. 6A shows B2M deletion efficiency for all gRNAs targeting B2M locus in HEK293T cells as measured by flow cytometry. Pooled data from 3 independent experiments shown as mean±SEM. FIG. 6B shows B2M deletion efficiencies of selected guides in HEK293T cells, measured as % InDels by CEL Surveyor assay. FIG. 6C is a comparison of B2M surface expression in HEK293T cells and primary CD4+ T cells when transfected with Cas9 and guide crB2M_13. FIG. 6D shows B2M deletion efficiency for selected guides targeting the B2M locus in primary CD4+ T-cells, as measured by flow cytometry. FIG. 6E shows B2M deletion efficiencies of selected guides in primary CD4+ T cells, measured as % InDels by CEL Surveyor assay.

FIG. 7A is a schematic of dual gRNA approach for targeting the B2M locus. gRNA pairs are in red. The offset in base pairs between Cas9 sites for each gRNA combination (right panel). FIG. 7B shows B2M deletion efficiency in CD4+ T cells for 6 dual gRNA combinations (n=3; mean±SEM). FIG. 7C is a FACS plots showing loss of B2M expression of either crB2M_13 or crB2M_8 alone or in combination in primary CD4+ T cells. FIG. 7D is a schematic of dual gRNA approach for targeting CCR5. gRNA pairs are shown in red. Orange and green arrowheads represent primer pairs used to amplify the region. The offset between the Cas9 sites of each gRNA pair (right panel). FIG. 7E is a gel electrophoresis image of CD34+ HSPCs derived clones targeted with crCCR5_D+Q analyzed by PCR. Note the deletion of the 205 bp region between the two gRNA cutting sites (top panel; WT: wild type; ACCR5: deleted; green * denotes a WT clone; orange * denotes a heterozygous clone; and red * denotes a homozygous deleted clone). Clonal deletion efficiency for three dual gRNA combinations targeting CCR5 in CD34+ HSPCs (n=4; % mean±SEM; bottom panel).

FIGS. 8A, 8B, 8C, 8D, 8E, 8F and 8G demonstrate the targeting efficiency of dual gRNA combinations. FIG. 8A shows B2M deletion efficiency for 6 dual gRNA combinations from three independent donors as measured by flow cytometry. FIG. 8B are FACS plots showing loss of MHC class I surface expression (bottom panel) following B2M deletion (top panel). FIG. 8C is a schematic of the single cell nested PCR strategy for the B2M locus (left panel), black and gray arrowheads: control primer pairs, orange and green arrowheads: primer pairs flanking targeting region. % B2M null single cells is shown (right panel, n=301). FIG. 8D is a Sanger sequencing chromatogram showing predicted deletion of targeted region at B2M locus. FIG. 8E shows clonal CCR5 deletion efficiency for three dual gRNA combinations in CD34+ HSPC-mPB obtained from multiple donors. DNA isolated from individual colony was analyzed by PCR and gel electrophoresis. FIG. 8F is a schematic of the single cell nested PCR strategy (left panel) for determining deletion of CCR5 in primary CD4+ T cells. % CCR5 null single cells is shown (right panel, n=363). FIG. 8G shows Sanger sequencing chromatogram shows predicted deletion at targeted region.

FIGS. 9A and 9B demonstrate potential off-target sites identified in CCR5 homologue CCR2 and analysis of events detected at the single off-target site in which mutagenesis was significantly detected above background. FIG. 9A shows a sequence alignment of CCR5 gRNAs utilized in this study in relation to the closest homologous sequence in CCR2 showing mismatched nucleotides in bold. Noteworthy is the fact that gRNA crCCR5_B, which yielded the sole significantly detected off-target mutagenesis in CCR2 (detailed in panel B), has 3 nucleotide mismatches, which are distal to the PAM (underlined) and seed (grey box) sequences. FIG. 9B shows a Table depicting results of in-depth analyses of all sequence reads at the single off-target site in which mutagenesis was significantly detected above background in both capture libraries treated with the associated gRNA (B; libraries treated with single gRNA crCCR5_B & dual-gRNA crCCR5_A+B), as well as the library treated with gRNA crCCR5_A as a comparison. Total off-target mutation frequency at this site was 0.6% in the single gRNA treatment (crCCR5_B) and notably decreased to 0.24% in the dual gRNA treatment (crCCR5_A+B) in which gRNA plasmid concentration of each gRNA was half of that utilized in single gRNA treatments.

FIGS. 10A, 10B, 10C and 10D demonstrate that CCR5-edited CD34+ HSPCs retain multi-lineage potential. FIG. 10A shows representative pictures of colonies formed in methylcellulose CFC assay (left panel) with quantified data on colony number and types are presented (right panel). Representative FACS plot showing human hematopoietic cell (hCD45+) engraftment and multi-lineage reconstitution at 12 weeks post-transplantation in the bone marrow (FIG. 10B) and spleen (FIG. 10C) of NSG recipient mice. FIG. 10D shows PCR results confirmed predicted deletion of targeted region at CCR5 locus in human hematopoietic cells sorted from NSG mice transplanted with CRISPR/Cas9-treated HSPCs. PBMC (human peripheral blood mononuclear cells) from healthy donor taken as control. (WT: wild type, ACCR5: deleted).

FIG. 11A is a schematic overview of targeted capture and deep sequencing of on-target and predicted off-target sites (red bar). A 500 bp region flanking the cutting site (in yellow) were included in sequence analysis for detection of structural rearrangements, including translocations. Probe sets are indicated in blue. FIG. 11B are plots showing consistent sequencing depth coverage at both on-target (left panel) and off-target (right panel) sites, achieving a coverage exceeding 3,000× for all on-target sites. Decrease in sequencing depth at the on-target sites in dual-gRNA libraries is marked by arrow, supporting predicted deletions (bottom left; i=35 bp, ii=205 bp, iii=205 bp). FIG. 11C shows a precise estimation of on-target mutation allele frequencies by capture sequencing. Notably, the observed rate of effective null mutation exceeds previous estimates by PCR validation of predictable deletions, as smaller InDels and inversions also occur at appreciable frequencies. FIG. 11D shows an estimation of mutation frequencies at predicted off-target sites (*One off-target site was statistically different from controls following correction for multiple comparisons; $p \leq 7.6 \times 10^{-11}$). N-fold enrichment is determined based on the ratio of non-reference reads in treated libraries compared to untreated library. Each value represents the average of all off-target sites for a given single gRNA or dual-gRNA experiment. Enrichment of 1 is equivalent to baseline (untreated control). **For reference to on-target enrichments, on-target combined represents the proportion of non-reference reads (including single and dual-gRNA treatments using a given gRNA) to total reads at on-target sites in treatment compared to control.

FIG. 12 shows predicted gRNA mapping in Ensembl GRCh37v71.

FIG. 13 shows guide pair crCCR5_A+B on-target alleles.

FIG. 14 shows guide pair crCCR5_C+D on-target alleles.

FIG. 15 shows guide pair crCCR5_D+Q on-target alleles.

FIG. 16A shows off-target sites with statistically significant mutational burden and FIG. 16B shows a comparison of on- and off-target mutational burdens.

FIG. 17 shows exemplary gRNA target sequences useful for targeting the human B2M gene using Cpf1.

FIG. 22A depicts a design of B2M TALEN and induced mutations.

DETAILED DESCRIPTION OF THE INVENTION

Figure 5A:
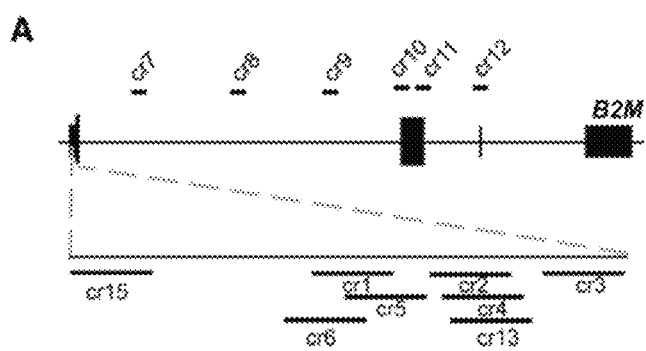

Work described herein demonstrates methods of B2M allele targeting using any system available, such as CRISPR/Cas or TALEN systems, resulting in primary human cell populations in which at least 25% of cells in the population comprise a deletion of a 2.2 kb stretch of contiguous genomic DNA in the B2M gene on chromosome 15, and as a result of such deletion those cells do not express MHC class I molecules on their surface. The genome edited cells thus modified can be used in allogeneic cell, tissue, or organ transplantations to reduce or eliminate the likelihood of triggering unwanted recipient immune responses when such cells are transplanted into the recipient. Moreover, methods of treatment (e.g., methods of treating HIV infection) utilizing compositions comprising mutant B2M alleles, as well as methods of administering such cells are also provided.

As used herein, the term "contacting" (i.e., contacting a polynucleotide sequence with a clustered regularly interspaced short palindromic repeats-associated (Cas) protein and/or ribonucleic acids) is intended to include incubating the Cas protein and/or the ribonucleic acids in the cell together in vitro (e.g., adding the Cas protein or nucleic acid encoding the Cas protein to cells in culture) or contacting a cell ex vivo. The step of contacting a target polynucleotide sequence with a Cas protein and/or ribonucleic acids as disclosed herein can be conducted in any suitable manner. For example, the cells may be treated in adherent culture, or in suspension culture. It is understood that the cells contacted with a Cas protein and/or ribonucleic acids as disclosed herein can also be simultaneously or subsequently contacted with another agent, such as a growth factor or other differentiation agent or environments to stabilize the cells, or to differentiate the cells further.

The terms "treat", "treating", "treatment", etc., as applied to an isolated cell, include subjecting the cell to any kind of process or condition or performing any kind of manipulation or procedure on the cell. As applied to a subject, the terms refer to administering a cell or population of cells in which a target polynucleotide sequence (e.g., B2M) has been altered ex vivo according to the methods described herein to an individual. The individual is usually ill or injured, or at increased risk of becoming ill relative to an average member of the population and in need of such attention, care, or management.

As used herein, the term "treating" and "treatment" refers to administering to a subject an effective amount of cells with target polynucleotide sequences altered ex vivo according to the methods described herein so that the subject has a reduction in at least one symptom of the disease or an improvement in the disease, for example, beneficial or desired clinical results. For purposes of this invention, beneficial or desired clinical results include, but are not limited to, alleviation of one or more symptoms, diminishment of extent of disease, stabilized (i.e., not worsening) state of disease, delay or slowing of disease progression, amelioration or palliation of the disease state, and remission (whether partial or total), whether detectable or undetectable. Treating can refer to prolonging survival as compared to expected survival if not receiving treatment. Thus, one of skill in the art realizes that a treatment may improve the disease condition, but may not be a complete cure for the disease. As used herein, the term "treatment" includes prophylaxis. Alternatively, treatment is "effective" if the progression of a disease is reduced or halted. "Treatment" can also mean prolonging survival as compared to expected survival if not receiving treatment. Those in need of treatment include those already diagnosed with a disorder associated with expression of a polynucleotide sequence, as well as those likely to develop such a disorder due to genetic susceptibility or other factors.

By "treatment," "prevention" or "amelioration" of a disease or disorder is meant delaying or preventing the onset of such a disease or disorder, reversing, alleviating, ameliorating, inhibiting, slowing down or stopping the progression, aggravation or deterioration the progression or severity of a condition associated with such a disease or disorder. In one embodiment, the symptoms of a disease or disorder are alleviated by at least 5%, at least 10%, at least 20%, at least 30%, at least 40%, or at least 50%.

The present invention contemplates altering target polynucleotide sequences in any manner which is available to the skilled artisan utilizing a CRISPR/Cas system of the present invention. Any CRISPR/Cas system that is capable of altering a target polynucleotide sequence in a cell can be used. Such CRISPR-Cas systems can employ a variety of Cas proteins (Haft et al. *PLoS Comput Biol.* 2005; 1(6)e60). The molecular machinery of such Cas proteins that allows the CRISPR/Cas system to alter target polynucleotide sequences in cells include RNA binding proteins, endo- and exo-nucleases, helicases, and polymerases. In some embodiments, the CRISPR/Cas system is a CRISPR type I system. In some embodiments, the CRISPR/Cas system is a CRISPR type II system. In some embodiments, the CRISPR/Cas system is a CRISPR type V system.

In additional or alternative aspects, the present invention contemplates altering target polynucleotide sequences in any manner which is available to the skilled artisan, e.g., utilizing a TALEN system. It should be understood that although examples of methods utilizing CRISPR/Cas (e.g., Cas9 and cpf1) and TALEN are described in detail herein, the invention is not limited to the use of these methods/systems. Other methods of targeting, e.g., B2M, to reduce or ablate expression in target cells known to the skilled artisan can be utilized herein.

The methods of the present invention can be used to alter a target polynucleotide sequence in a cell. The present invention contemplates altering target polynucleotide sequences in a cell for any purpose. In some embodiments, the target polynucleotide sequence in a cell is altered to produce a mutant cell. As used herein, a "mutant cell" refers to a cell with a resulting genotype that differs from its original genotype. In some instances, a "mutant cell" exhibits a mutant phenotype, for example when a normally functioning gene is altered using the CRISPR/Cas systems of the present invention. In other instances, a "mutant cell" exhibits a wild-type phenotype, for example when a CRISPR/Cas system of the present invention is used to correct a mutant genotype. In some embodiments, the target polynucleotide sequence in a cell is altered to correct or repair a genetic mutation (e.g., to restore a normal phenotype to the cell). In some embodiments, the target polynucleotide sequence in a cell is altered to induce a genetic mutation (e.g., to disrupt the function of a gene or genomic element).

In some embodiments, the alteration is an indel. As used herein, "indel" refers to a mutation resulting from an insertion, deletion, or a combination thereof. As will be appreciated by those skilled in the art, an indel in a coding region of a genomic sequence will result in a frameshift mutation, unless the length of the indel is a multiple of three. In some embodiments, the alteration is a point mutation. As used herein, "point mutation" refers to a substitution that replaces one of the nucleotides. A CRISPR/Cas system of the present invention can be used to induce an indel of any length or a point mutation in a target polynucleotide sequence.

In some embodiments, the alteration results in a knock out of the target polynucleotide sequence or a portion thereof. Knocking out a target polynucleotide sequence or a portion thereof using a CRISPR/Cas system of the present invention can be useful for a variety of applications. For example, knocking out a target polynucleotide sequence in a cell can be performed in vitro for research purposes. For ex vivo purposes, knocking out a target polynucleotide sequence in a cell can be useful for treating or preventing a disorder associated with expression of the target polynucleotide sequence (e.g., by knocking out a mutant allele in a cell ex vivo and introducing those cells comprising the knocked out mutant allele into a subject).

As used herein, "knock out" includes deleting all or a portion of the target polynucleotide sequence in a way that interferes with the function of the target polynucleotide sequence. For example, a knock out can be achieved by altering a target polynucleotide sequence by inducing an indel in the target polynucleotide sequence in a functional domain of the target polynucleotide sequence (e.g., a DNA binding domain). Those skilled in the art will readily appreciate how to use the CRISPR/Cas systems of the present invention to knock out a target polynucleotide sequence or a portion thereof based upon the details described herein.

In some embodiments, the alteration results in reduced expression of the target polynucleotide sequence. The terms "decrease," "reduced," "reduction," and "decrease" are all used herein generally to mean a decrease by a statistically significant amount. However, for avoidance of doubt, decrease," "reduced," "reduction," "decrease" means a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (i.e. absent level as compared to a reference sample), or any decrease between 10-100% as compared to a reference level.

The terms "increased", "increase" or "enhance" or "activate" are all used herein to generally mean an increase by a statically significant amount; for the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

The term "statistically significant" or "significantly" refers to statistical significance and generally means a two standard deviation (2SD) below normal, or lower, concentration of the marker. The term refers to statistical evidence that there is a difference. It is defined as the probability of making a decision to reject the null hypothesis when the null hypothesis is actually true. The decision is often made using the p-value.

In some embodiments, the alteration is a homozygous alteration. In some embodiments, the alteration is a heterozygous alteration.

In some embodiments, the alteration results in correction of the target polynucleotide sequence from an undesired sequence to a desired sequence. The CRISPR/Cas systems of the present invention can be used to correct any type of mutation or error in a target polynucleotide sequence. For example, the CRISPR/Cas systems of the present invention can be used to insert a nucleotide sequence that is missing from a target polynucleotide sequence due to a deletion. The CRISPR/Cas systems of the present invention can also be used to delete or excise a nucleotide sequence from a target polynucleotide sequence due to an insertion mutation. In some instances, the CRISPR/Cas systems of the present invention can be used to replace an incorrect nucleotide sequence with a correct nucleotide sequence (e.g., to restore function to a target polynucleotide sequence that is impaired due to a loss of function mutation, i.e., a SNP).

The CRISPR/Cas systems of the present invention can alter target polynucleotides with surprisingly high efficiency as compared to conventional CRISPR/Cas systems. In certain embodiments, the efficiency of alteration is at least about 5%. In certain embodiments, the efficiency of alteration is at least about 10%. In certain embodiments, the efficiency of alteration is from about 10% to about 80%. In certain embodiments, the efficiency of alteration is from about 30% to about 80%. In certain embodiments, the efficiency of alteration is from about 50% to about 80%. In some embodiments, the efficiency of alteration is greater than or equal to about 80%.

The CRISPR/Cas systems of the present invention can be used to alter any target polynucleotide sequence in a cell. Those skilled in the art will readily appreciate that desirable target polynucleotide sequences to be altered in any particular cell may correspond to any genomic sequence for which expression of the genomic sequence is associated with a disorder or otherwise facilitates entry of a pathogen into the cell. For example, a desirable target polynucleotide sequence to alter in a cell may be a polynucleotide sequence corresponding to a genomic sequence which contains a disease associated single polynucleotide polymorphism. In such example, the CRISPR/Cas systems of the present invention can be used to correct the disease associated SNP in a cell by replacing it with a wild-type allele. As another example, a polynucleotide sequence of a target gene which is responsible for entry or proliferation of a pathogen into a cell may be a suitable target for deletion or insertion to disrupt the function of the target gene to prevent the pathogen from entering the cell or proliferating inside the cell.

In some embodiments, the target polynucleotide sequence is a genomic sequence. In some embodiments, the target polynucleotide sequence is a human genomic sequence. In some embodiments, the target polynucleotide sequence is a mammalian genomic sequence. In some embodiments, the target polynucleotide sequence is a vertebrate genomic sequence.

In some embodiments, a target polynucleotide sequence is a pathogenic genomic sequence. Exemplary pathogenic genomic sequences include, but are not limited to a viral genomic sequence, a bacterial genomic sequence, a fungal genomic sequence, a toxin genomic sequence, or a parasitic genomic sequence. In such embodiments, the CRISPR/Cas systems of the present invention can be used to disrupt the function of a pathogen (e.g., to treat or prevent an infection by the pathogen) by cleaving a genomic sequence of the pathogen (e.g., a genomic sequence that is critical for entry into a cell, or responsible for multiplication, growth or survival once the pathogen is inside a cell).

In some embodiments, the target polynucleotide sequence is beta-2-microglobulin (B2M; Gene ID: 567). The B2M polynucleotide sequence encodes a serum protein associated with the heavy chain of the major histocompatibility complex (MHC) class I molecules which are expressed on the surface of virtually all nucleated cells. B2M protein comprises a beta-pleated sheet structure that has been found to form amyloid fibrils in certain pathological conditions. The B2M gene has 4 exons which span approximately 8 kb. B2M has been observed in the serum of normal individuals and in elevated amounts in urine from patients having Wilson disease, cadmium poisoning, and various conditions leading to renal tubular dysfunction. Other pathological conditions known to be associated with the B2M include, without limitation, a homozygous mutation (e.g., ala11pro) in the B2M gene has been reported in individuals having familial hypercatabolic hypoproteinemia, a heterozygous mutation (e.g., asp76asn) in the B2M gene has been reported in individuals having familial visceral amyloidosis.

In some embodiments, the target polynucleotide sequence is a variant of B2M. In some embodiments, the target polynucleotide sequence is a homolog of B2M. In some embodiments, the target polynucleotide sequence is an ortholog of B2M.

In some aspects, the present disclosure provides a primary human cell or population of primary human cells comprising a genome in which the β2-microglobulin (B2M) gene on chromosome 15 has been edited to delete a contiguous stretch of genomic DNA comprising base pairs 5109 to 7331 (SEQ ID NO: 1) of NCBI Reference Sequence: NG_012920.1, thereby eliminating surface expression of MHC class I molecules in the cell or population of cells.

The contiguous stretch of genomic DNA can be deleted by contacting the cell or population of human cells with a Cas protein or a nucleic acid encoding the Cas protein and a pair of ribonucleic acids targeting SEQ ID NO: 16 and SEQ ID NO: 21.

The contiguous stretch of genomic DNA can be deleted by contacting the cell or population of human cells with a Cas protein or a nucleic acid encoding the Cas protein and a single ribonucleic acid targeting a sequence selected from the group consisting of SEQ ID NOs: 419-880.

The present disclosure contemplates ablating MHC class I molecule surface expression in any primary human cell population to produce cells which reduce or eliminate the likelihood of triggering unwanted host immune responses when transplanted (e.g., allogeneic transplantation). The cells can be obtained from a subject suffering from, being treated for, diagnosed with, suspected of having, or at increased risk of developing, the disorder such as a genetic disorder, an infection (e.g., HIV or AIDS), and cancer. The cells can also be obtained from a normal healthy subject not suffering from, being treated for, diagnosed with, suspected of having, or at increased risk of developing, the disorder.

The present invention contemplates genomically editing primary human cells to cleave B2M gene sequences, as well as editing the genome of such cells to alter one or more additional target polynucleotide sequences.

In some aspects, the invention provides a method for altering a target B2M polynucleotide sequence in a cell comprising contacting the B2M polynucleotide sequence with a clustered regularly interspaced short palindromic repeats-associated (Cas) protein and from one to two ribonucleic acids, wherein the ribonucleic acids direct Cas protein to and hybridize to a target motif of the target B2M polynucleotide sequence, wherein the target B2M polynucleotide sequence is cleaved, and wherein at least one of the one to two ribonucleic acids targets a sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23.

In some aspects, the invention provides a method for altering a target B2M polynucleotide sequence in a cell comprising contacting the B2M polynucleotide sequence with a clustered regularly interspaced short palindromic repeats-associated (Cas) protein and from one to two ribonucleic acids, wherein the ribonucleic acids direct Cas protein to and hybridize to a target motif of the target B2M polynucleotide sequence, wherein the target B2M polynucleotide sequence is cleaved, and wherein at least one of the one to two ribonucleic acids targets a sequence selected from the group consisting of SEQ ID NOs: 881-2609.

In some embodiments, each of the one to two ribonucleic acids is selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23.

In some embodiments, each of the one to two ribonucleic acids targets a sequence selected from the group consisting of SEQ ID NOs: 881-2609.

In some aspects, the invention provides a method for altering a target B2M polynucleotide sequence in a cell comprising contacting the B2M polynucleotide sequence with a clustered regularly interspaced short palindromic repeats-associated (Cas) protein and one ribonucleic acid, wherein the ribonucleic acid directs Cas protein to and hybridizes to a target motif of the target B2M polynucleotide sequence, wherein the target B2M polynucleotide sequence is cleaved, and the ribonucleic acid targets a sequence selected from the group consisting of SEQ ID NOs: 419-880.

In some aspects, the invention provides a method for treating or preventing a disorder associated with expression of a polynucleotide sequence in a subject, the method comprising: (a) altering a target polynucleotide sequence associated with the disorder in a cell ex vivo by contacting the polynucleotide sequence with a clustered regularly interspaced short palindromic repeats-associated (Cas) protein and from one to two ribonucleic acids, wherein the ribonucleic acids direct Cas protein to and hybridize to a target motif of the target polynucleotide sequence associated with the disorder, wherein the target polynucleotide sequence associated with the disorder is cleaved; (b) altering a target B2M polynucleotide sequence in the cell ex vivo by contacting the target B2M polynucleotide sequence with a clustered regularly interspaced short palindromic repeats-associated (Cas) protein and two ribonucleic acids targeting a sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, and SEQ ID NO: 23; and (c) introducing the cell into the subject, thereby treating or preventing a disorder associated with expression of the polynucleotide sequence. In some aspects, the two ribonucleic acids targets a sequence selected from the group consisting of SEQ ID NOs: 881-2609.

In some embodiments, the target polynucleotide sequence is CCR5 (Gene ID: 1234, also known as CC-CKR-5, CCCKR5, CCR-5, CD195, CKR-5, CKR5, CMKBR5, and IDDM22). In some embodiments, the target polynucleotide sequence is a variant of CCR5. In some embodiments, the target polynucleotide sequence is a homolog of CCR5. In some embodiments, the target polynucleotide sequence is an ortholog of CCR5. In some embodiments, the primary cell or population of primary cells comprises a genome in which the CCR5 gene has been edited to eliminate CCR5 surface expression.

In some embodiments, the target polynucleotide sequence is CXCR4 (Gene ID: 7852, also known as FB22; HM89; LAP3; LCR1; NPYR; WHIM; CD184; LESTR; NPY3R; NPYRL; HSY3RR; NPYY3R; and D2S201E). In some embodiments, the target polynucleotide sequence is a variant of CXCR4. In some embodiments, the target polynucleotide sequence is a homolog of CXCR4. In some embodiments, the target polynucleotide sequence is an ortholog of CXCR4. In some embodiments, the primary cell or population of primary cells comprises a genome in which the CXCR4 gene has been edited to eliminate CCR5 surface expression.

In some aspects, the invention provides a method for treating or preventing a disorder associated with expression of a polynucleotide sequence in a subject, the method comprising: (a) altering a target polynucleotide sequence associated with the disorder in a cell ex vivo by contacting the polynucleotide sequence with a clustered regularly interspaced short palindromic repeats-associated (Cas) protein and at least one ribonucleic acid, wherein the at least one ribonucleic acid directs Cas protein to and hybridizes to a target motif of the target polynucleotide sequence associated with the disorder, wherein the target polynucleotide sequence associated with the disorder is cleaved; (b) altering a target B2M polynucleotide sequence in the cell ex vivo by contacting the target B2M polynucleotide sequence with a clustered regularly interspaced short palindromic repeats-associated (Cas) protein and one ribonucleic acid selected from the group consisting of SEQ ID NOs: 419-880; and (c) introducing the cell into the subject, thereby treating or preventing a disorder associated with expression of the polynucleotide sequence.

In some embodiments, the target polynucleotide sequence is CCR5. In some embodiments, the target polynucleotide sequence is a variant of CCR5. In some embodiments, the target polynucleotide sequence is a homolog of CCR5. In some embodiments, the target polynucleotide sequence is an ortholog of CCR5. In some embodiments, the primary cell or population of primary cells comprises a genome in which the CCR5 gene has been edited to eliminate CCR5 surface expression.

In some embodiments, the target polynucleotide sequence is CXCR4. In some embodiments, the target polynucleotide sequence is a variant of CXCR4. In some embodiments, the target polynucleotide sequence is a homolog of CXCR4. In some embodiments, the target polynucleotide sequence is an ortholog of CXCR4. In some embodiments, the primary cell or population of primary cells comprises a genome in which the CXCR4 gene has been edited to eliminate CXCR4 surface expression.

It should be appreciated that the CRISPR/Cas systems of the present invention can cleave target polynucleotide sequences in a variety of ways. In some embodiments, the target polynucleotide sequence is cleaved such that a double-strand break results. In some embodiments, the target polynucleotide sequence is cleaved such that a single-strand break results.

The methods of the present invention can be used to alter any target polynucleotide sequence in a cell, as long as the target polynucleotide sequence in the cell contains a suitable target motif that allows at least one ribonucleic acid of the CRISPR/Cas system to direct the Cas protein to and hybridize to the target motif. Those skilled in the art will appreciate that the target motif for targeting a particular polynucleotide depends on the CRISPR/Cas system being used, and the sequence of the polynucleotide to be targeted.

In some embodiments, the target motif is 17 to 23 bp in length. In some embodiments, the target motif is at least 20 bp in length. In some embodiments, the target motif is a 20-nucleotide DNA sequence. In some embodiments, the target motif is a 20-nucleotide DNA sequence beginning with G and immediately precedes an NGG motif recognized by the Cas protein. In some embodiments, the target motif is $G(N)_{19}NGG$. In some embodiments, the target motif is a 20-nucleotide DNA sequence and immediately precedes an NGG motif recognized by the Cas protein. In some embodiments, the target motif is (N)20NGG.

In some embodiments, the target motif is 17 to 23 bp in length. In some embodiments, the target motif is at least 20 bp in length. In some embodiments, the target motif is a 20-nucleotide DNA sequence. In some embodiments, the target motif is a 20-nucleotide DNA sequence having a 5' T-rich region (e.g. TTTN motif).

The target motifs of the present invention can be selected to minimize off-target effects of the CRISPR/Cas systems of the present invention. In some embodiments, the target motif is selected such that it contains at least two mismatches when compared with all other genomic nucleotide sequences in the cell. In some embodiments, the target motif is selected such that it contains at least one mismatch when compared with all other genomic nucleotide sequences in the cell. Those skilled in the art will appreciate that a variety of techniques can be used to select suitable target motifs for minimizing off-target effects (e.g., bioinformatics analyses).

In some embodiments, the target motif comprises a $G(N)_{19}NGG$ or $(N)_{20}NGG$ DNA sequence in the B2M gene. In some embodiments, the target motif comprises a $G(N)_{19}NGG$ or $(N)_{20}NGG$ DNA sequence in SEQ ID NO: 1. In some embodiments, the target motif comprises a DNA sequence selected from the group consisting of SEQ ID NOs: 16 and 21.

In some embodiments, the target motif comprises a DNA sequence comprising at least one nucleotide mismatch compared to a $G(N)_{19}NGG$ or $(N)_{20}NGG$ DNA sequence in the B2M gene. In some embodiments, the target motif comprises a DNA sequence comprising at least one nucleotide mismatch compared to a $G(N)_{19}NGG$ or $(N)_{20}NGG$ DNA sequence in SEQ ID NO: 1. In some embodiments, the target motif comprises a DNA sequence comprising at least one nucleotide mismatch compared to a DNA sequence selected from the group consisting of SEQ ID NOs: 16 and 21.

In some embodiments, the target motif comprises a DNA sequence comprising at least two nucleotide mismatches compared to a $G(N)_{19}NGG$ or $(N)_{20}NGG$ DNA sequence in the B2M gene. In some embodiments, the target motif comprises a DNA sequence comprising at least two nucleotide mismatches compared to a $G(N)_{19}NGG$ or $(N)_{20}NGG$ DNA sequence in SEQ ID NO: 1.

In some embodiments, the target motif comprises a DNA sequence comprising at least two nucleotide mismatches compared to a DNA sequence selected from the group consisting of SEQ ID NOs: 16 and 21.

In some embodiments, the CRISPR/Cas systems of the present invention utilize homology-directed repair to correct target polynucleotide sequences. In some embodiments, subsequent to cleavage of the target polynucleotide sequence, homology-directed repair occurs. In some embodiments, homology-directed repair is performed using an exogenously introduced DNA repair template. The exogenously introduced DNA repair template can be single-stranded or double-stranded. The DNA repair template can be of any length. Those skilled in the art will appreciate that the length of any particular DNA repair template will depend on the target polynucleotide sequence that is to be corrected. The DNA repair template can be designed to repair or replace any target polynucleotide sequence, particularly target polynucleotide sequences comprising disease associated polymorphisms (e.g., SNPs). For example, homology-directed repair of a mutant allele comprising such SNPs can be achieved with a CRISPR/Cas system by selecting two target motifs which flank the mutant allele, and an designing a DNA repair template to match the wild-type allele.

In some embodiments, a CRISPR/Cas system of the present invention includes a Cas protein and at least one to two ribonucleic acids that are capable of directing the Cas protein to and hybridizing to a target motif of a target polynucleotide sequence. As used herein, "protein" and "polypeptide" are used interchangeably to refer to a series of amino acid residues joined by peptide bonds (i.e., a polymer of amino acids) and include modified amino acids (e.g., phosphorylated, glycated, glycosolated, etc.) and amino acid analogs. Exemplary polypeptides or proteins include gene products, naturally occurring proteins, homologs, paralogs, fragments and other equivalents, variants, and analogs of the above.

In some embodiments, a Cas protein comprises one or more amino acid substitutions or modifications. In some embodiments, the one or more amino acid substitutions comprises a conservative amino acid substitution. In some instances, substitutions and/or modifications can prevent or reduce proteolytic degradation and/or extend the half-life of the polypeptide in a cell. In some embodiments, the Cas protein can comprise a peptide bond replacement (e.g., urea, thiourea, carbamate, sulfonyl urea, etc.). In some embodiments, the Cas protein can comprise a naturally occurring amino acid. In some embodiments, the Cas protein can comprise an alternative amino acid (e.g., D-amino acids, beta-amino acids, homocysteine, phosphoserine, etc.). In some embodiments, a Cas protein can comprise a modification to include a moiety (e.g., PEGylation, glycosylation, lipidation, acetylation, end-capping, etc.).

In some embodiments, a Cas protein comprises a core Cas protein. Exemplary Cas core proteins include, but are not limited to Cas1, Cas2, Cas3, Cas4, Cas5, Cas6, Cas7, Cas8 and Cas9. In some embodiments, a Cas protein comprises a Cas protein of an *E. coli* subtype (also known as CASS2). Exemplary Cas proteins of the *E. Coli* subtype include, but are not limited to, Cse1, Cse2, Cse3, Cse4, and Cas5e. In some embodiments, a Cas protein comprises a Cas protein of the Ypest subtype (also known as CASS3). Exemplary Cas proteins of the Ypest subtype include, but are not limited to Csy1, Csy2, Csy3, and Csy4. In some embodiments, a Cas protein comprises a Cas protein of the Nmeni subtype (also known as CASS4). Exemplary Cas proteins of the Nmeni subtype include, but are not limited to Csn1 and Csn2. In some embodiments, a Cas protein comprises a Cas protein of the Dvulg subtype (also known as CASS1). Exemplary Cas proteins of the Dvulg subtype include Csd1, Csd2, and Cas5d. In some embodiments, a Cas protein comprises a Cas protein of the Tneap subtype (also known as CASS7). Exemplary Cas proteins of the Tneap subtype include, but are not limited to, Cst1, Cst2, Cas5t. In some embodiments, a Cas protein comprises a Cas protein of the Hmari subtype.

Exemplary Cas proteins of the Hmari subtype include, but are not limited to Csh1, Csh2, and Cas5h. In some embodiments, a Cas protein comprises a Cas protein of the Apern subtype (also known as CASS5). Exemplary Cas proteins of the Apern subtype include, but are not limited to Csa1, Csa2, Csa3, Csa4, Csa5, and Cas5a. In some embodiments, a Cas protein comprises a Cas protein of the Mtube subtype (also known as CASS6). Exemplary Cas proteins of the Mtube subtype include, but are not limited to Csm1, Csm2, Csm3, Csm4, and Csm5. In some embodiments, a Cas protein comprises a RAMP module Cas protein. Exemplary RAMP module Cas proteins include, but are not limited to, Cmr1, Cmr2, Cmr3, Cmr4, Cmr5, and Cmr6.

In some embodiments, the Cas protein is a *Streptococcus pyogenes* Cas9 protein or a functional portion thereof. In some embodiments, the Cas protein is Cas9 protein from any bacterial species or functional portion thereof. Cas9 protein is a member of the type II CRISPR systems which typically include a trans-coded small RNA (tracrRNA), endogenous ribonuclease 3 (rnc) and a Cas protein. Cas 9 protein (also known as CRISPR-associated endonuclease Cas9/Csn1) is a polypeptide comprising 1368 amino acids. An exemplary amino acid sequence of a Cas9 protein (SEQ ID NO: 298) is shown in FIG. 4. Cas 9 contains 2 endonuclease domains, including an RuvC-like domain (residues 7-22, 759-766 and 982-989) which cleaves target DNA that is noncomplementary to crRNA, and an HNH nuclease domain (residues 810-872) which cleave target DNA complementary to crRNA. In FIG. 4, the RuvC-like domain is highlighted in yellow and the HNH nuclease domain is underlined.

In some embodiments, the Cas protein is Cpf1 protein or a functional portion thereof. In some embodiments, the Cas protein is Cpf1 from any bacterial species or functional portion thereof. In some aspects, Cpf1 is a *Francisella novicida* U112 protein or a functional portion thereof. In some aspects, Cpf1 is a *Acidaminococcus* sp. BV3L6 protein or a functional portion thereof. In some aspects, Cpf1 is a *Lachnospiraceae bacterium* ND2006 protein or a function portion thereof. Cpf1 protein is a member of the type V CRISPR systems. Cpf1 protein is a polypeptide comprising about 1300 amino acids. Cpf1 contains a RuvC-like endonuclease domain. Cpf1 cleaves target DNA in a staggered pattern using a single ribonuclease domain. The staggered DNA double-stranded break results in a 4 or 5-nt 5' overhang.

As used herein, "functional portion" refers to a portion of a peptide which retains its ability to complex with at least one ribonucleic acid (e.g., guide RNA (gRNA)) and cleave a target polynucleotide sequence. In some embodiments, the functional portion comprises a combination of operably linked Cas9 protein functional domains selected from the group consisting of a DNA binding domain, at least one RNA binding domain, a helicase domain, and an endonuclease domain. In some embodiments, the functional portion comprises a combination of operably linked Cpf1 protein functional domains selected from the group consisting of a DNA binding domain, at least one RNA binding domain, a helicase domain, and an endonuclease domain. In some embodiments, the functional domains form a complex. In some embodiments, a functional portion of the Cas9 protein comprises a functional portion of a RuvC-like domain. In some embodiments, a functional portion of the Cas9 protein comprises a functional portion of the HNH nuclease domain. In some embodiments, a functional portion of the Cpf1 protein comprises a functional portion of a RuvC-like domain.

It should be appreciated that the present invention contemplates various of ways of contacting a target polynucleotide sequence with a Cas protein (e.g., Cas9). In some embodiments, exogenous Cas protein can be introduced into the cell in polypeptide form. In certain embodiments, Cas proteins can be conjugated to or fused to a cell-penetrating polypeptide or cell-penetrating peptide. As used herein, "cell-penetrating polypeptide" and "cell-penetrating peptide" refers to a polypeptide or peptide, respectively, which facilitates the uptake of molecule into a cell. The cell-penetrating polypeptides can contain a detectable label.

In certain embodiments, Cas proteins can be conjugated to or fused to a charged protein (e.g., that carries a positive, negative or overall neutral electric charge). Such linkage may be covalent. In some embodiments, the Cas protein can be fused to a superpositively charged GFP to significantly increase the ability of the Cas protein to penetrate a cell (Cronican et al. *ACS Chem Biol.* 2010; 5(8):747-52). In certain embodiments, the Cas protein can be fused to a protein transduction domain (PTD) to facilitate its entry into a cell. Exemplary PTDs include Tat, oligoarginine, and penetratin. In some embodiments, the Cas9 protein comprises a Cas9 polypeptide fused to a cell-penetrating peptide. In some embodiments, the Cas9 protein comprises a Cas9 polypeptide fused to a PTD. In some embodiments, the Cas9 protein comprises a Cas9 polypeptide fused to a tat domain. In some embodiments, the Cas9 protein comprises a Cas9 polypeptide fused to an oligoarginine domain. In some embodiments, the Cas9 protein comprises a Cas9 polypeptide fused to a penetratin domain. In some embodiments, the Cas9 protein comprises a Cas9 polypeptide fused to a superpositively charged GFP. In some embodiments, the Cpf1 protein comprises a Cpf1 polypeptide fused to a cell-penetrating peptide. In some embodiments, the Cpf1 protein comprises a Cpf1 polypeptide fused to a PTD. In some embodiments, the Cpf1 protein comprises a Cpf1 polypeptide fused to a tat domain. In some embodiments, the Cpf1 protein comprises a Cpf1 polypeptide fused to an oligoarginine domain. In some embodiments, the Cpf1 protein comprises a Cpf1 polypeptide fused to a penetratin domain. In some embodiments, the Cpf1 protein comprises a Cpf1 polypeptide fused to a superpositively charged GFP.

In some embodiments, the Cas protein can be introduced into a cell containing the target polynucleotide sequence in the form of a nucleic acid encoding the Cas protein (e.g., Cas9 or Cpf1). The process of introducing the nucleic acids into cells can be achieved by any suitable technique. Suitable techniques include calcium phosphate or lipid-mediated transfection, electroporation, and transduction or infection using a viral vector. In some embodiments, the nucleic acid comprises DNA. In some embodiments, the nucleic acid comprises a modified DNA, as described herein. In some embodiments, the nucleic acid comprises mRNA. In some embodiments, the nucleic acid comprises a modified mRNA, as described herein (e.g., a synthetic, modified mRNA).

In some embodiments, the Cas protein is complexed with one to two ribonucleic acids. In some embodiments, the Cas protein is complexed with two ribonucleic acids. In some embodiments, the Cas protein is complexed with one ribonucleic acid. In some embodiments, the Cas protein is encoded by a modified nucleic acid, as described herein (e.g., a synthetic, modified mRNA).

The methods of the present invention contemplate the use of any ribonucleic acid that is capable of directing a Cas protein to and hybridizing to a target motif of a target polynucleotide sequence. In some embodiments, at least one of the ribonucleic acids comprises tracrRNA. In some embodiments, at least one of the ribonucleic acids comprises CRISPR RNA (crRNA). In some embodiments, a single ribonucleic acid comprises a guide RNA that directs the Cas protein to and hybridizes to a target motif of the target polynucleotide sequence in a cell. In some embodiments, at least one of the ribonucleic acids comprises a guide RNA that directs the Cas protein to and hybridizes to a target motif of the target polynucleotide sequence in a cell. In some embodiments, both of the one to two ribonucleic acids comprise a guide RNA that directs the Cas protein to and hybridizes to a target motif of the target polynucleotide sequence in a cell. The ribonucleic acids of the present invention can be selected to hybridize to a variety of different target motifs, depending on the particular CRISPR/Cas system employed, and the sequence of the target polynucleotide, as will be appreciated by those skilled in the art. The one to two ribonucleic acids can also be selected to minimize hybridization with nucleic acid sequences other than the target polynucleotide sequence. In some embodiments, the one to two ribonucleic acids hybridize to a target motif that contains at least two mismatches when compared with all other genomic nucleotide sequences in the cell. In some embodiments, the one to two ribonucleic acids hybridize to a target motif that contains at least one mismatch when compared with all other genomic nucleotide sequences in the cell. In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs.

In some embodiments, at least one of the one to two ribonucleic acids comprises a sequence selected from the group consisting of the ribonucleic acid sequences of FIG. 1 in WIPO Publication No. WO2014/165825. In some embodiments, at least one of the one to two ribonucleic acids comprises a sequence with a single nucleotide mismatch to a sequence selected from the group consisting of the ribonucleic acid sequences of FIG. 1 in WIPO Publication No. WO2014/165825.

In some embodiments, at least one of the one to two ribonucleic acids comprises a sequence selected from the group consisting of the ribonucleic acid sequences of FIG. 2 in WIPO Publication No. WO2014/165825. In some embodiments, at least one of the one to two ribonucleic acids comprises a sequence with a single nucleotide mismatch to a sequence selected from the group consisting of the ribonucleic acid sequences of FIG. 2 in WIPO Publication No. WO2014/165825.

In some embodiments, each of the one to two ribonucleic acids comprises guide RNAs that directs the Cas protein to and hybridizes to a target motif of the target polynucleotide sequence in a cell.

In some embodiments, one or two ribonucleic acids (e.g., guide RNAs) are complementary to and/or hybridize to sequences on the same strand of a target polynucleotide sequence. In some embodiments, one or two ribonucleic acids (e.g., guide RNAs) are complementary to and/or hybridize to sequences on the opposite strands of a target polynucleotide sequence. In some embodiments, the one or two ribonucleic acids (e.g., guide RNAs) are not complementary to and/or do not hybridize to sequences on the opposite strands of a target polynucleotide sequence. In some embodiments, the one or two ribonucleic acids (e.g., guide RNAs) are complementary to and/or hybridize to overlapping target motifs of a target polynucleotide sequence. In some embodiments, the one or two ribonucleic acids (e.g., guide RNAs) are complementary to and/or hybridize to offset target motifs of a target polynucleotide sequence.

The present invention also contemplates multiplex genomic editing. Those skilled in the art will appreciate that the description above with respect to genomic editing of a single gene is equally applicable to the multiplex genomic editing embodiments described below.

As used herein, the terms "administering," "introducing" and "transplanting" are used interchangeably in the context of the placement of cells, e.g. cells described herein comprising a target polynucleotide sequence altered according to the methods of the invention into a subject, by a method or route which results in at least partial localization of the introduced cells at a desired site. The cells can be implanted directly to the desired site, or alternatively be administered by any appropriate route which results in delivery to a desired location in the subject where at least a portion of the implanted cells or components of the cells remain viable. The period of viability of the cells after administration to a subject can be as short as a few hours, e. g. twenty-four hours, to a few days, to as long as several years. In some instances, the cells can also be administered a location other than the desired site, such as in the liver or subcutaneously, for example, in a capsule to maintain the implanted cells at the implant location and avoid migration of the implanted cells.

For ex vivo methods, cells can include autologous cells, i.e., a cell or cells taken from a subject who is in need of altering a target polynucleotide sequence in the cell or cells (i.e., the donor and recipient are the same individual). Autologous cells have the advantage of avoiding any immunologically-based rejection of the cells. Alternatively, the cells can be heterologous, e.g., taken from a donor. The second subject can be of the same or different species. Typically, when the cells come from a donor, they will be from a donor who is sufficiently immunologically compatible with the recipient, i.e., will not be subject to transplant rejection, to lessen or remove the need for immunosuppression. In some embodiments, the cells are taken from a xenogeneic source, i.e., a non-human mammal that has been genetically engineered to be sufficiently immunologically compatible with the recipient, or the recipient's species. Methods for determining immunological compatibility are known in the art, and include tissue typing to assess donor-recipient compatibility for HLA and ABO determinants. See, e.g., *Transplantation Immunology*, Bach and Auchincloss, Eds. (Wiley, John & Sons, Incorporated 1994).

Any suitable cell culture media can be used for ex vivo methods of the invention.

The terms "subject" and "individual" are used interchangeably herein, and refer to an animal, for example, a human from whom cells can be obtained and/or to whom treatment, including prophylactic treatment, with the cells as described herein, is provided. For treatment of those infections, conditions or disease states which are specific for a specific animal such as a human subject, the term subject refers to that specific animal. The "non-human animals" and "non-human mammals" as used interchangeably herein, includes mammals such as rats, mice, rabbits, sheep, cats, dogs, cows, pigs, and non-human primates. The term "subject" also encompasses any vertebrate including but not limited to mammals, reptiles, amphibians and fish. However, advantageously, the subject is a mammal such as a human, or other mammals such as a domesticated mammal, e.g. dog, cat, horse, and the like, or production mammal, e.g. cow, sheep, pig, and the like.

In some embodiments, the alteration results in reduced expression of the target polynucleotide sequences. In some embodiments, the alteration results in a knock out of the target polynucleotide sequences. In some embodiments, the alteration results in correction of the target polynucleotide sequences from undesired sequences to desired sequences. In some embodiments, each alteration is a homozygous alteration. In some embodiments, the efficiency of alteration at each loci is from about 5% to about 80%. In some embodiments, the efficiency of alteration at each loci is from about 10% to about 80%. In some embodiments, the efficiency of alteration at each loci is from about 30% to about 80%. In some embodiments, the efficiency of alteration at each loci is from about 50% to about 80%. In some embodiments, the efficiency of alteration at each loci is from greater than or equal to about 80%.

In some embodiments, each target polynucleotide sequence is cleaved such that a double-strand break results. In some embodiments, each target polynucleotide sequence is cleaved such that a single-strand break results.

In some embodiments, the target polynucleotide sequences comprise multiple different portions of B2M. In some embodiments, the target polynucleotide sequences comprise multiple different portions of CCR5. In some embodiments, the target polynucleotide sequences comprise multiple different portions of CXCR4. In some embodiments, the target polynucleotide sequences comprise at least a portion of CCR5 and at least a portion of CXCR4.

In some embodiments, each target motif is a 17 to 23 nucleotide DNA sequence. In some embodiments, each target motif is a 20-nucleotide DNA sequence. In some embodiments, each target motif is a 20-nucleotide DNA sequence with a 5' T-rich region. In some embodiments, each target motif is a 20-nucleotide DNA sequence beginning with G and immediately precedes an NGG motif recognized by the Cas protein. In some embodiments, each target motif is a 20-nucleotide DNA sequence and immediately precedes an NGG motif recognized by the Cas protein. In some embodiments, each target motif is G(N)19NGG. In some embodiments, each target motif is (N)20NGG. In some embodiments, each target motif is selected such that it contains at least two mismatches when compared with all other genomic nucleotide sequences in the cell. In some embodiments, each target motif is selected such that it contains at least two mismatches when compared with all other genomic nucleotide sequences in the cell.

In some embodiments, subsequent to cleavage of the target polynucleotide sequences, homology-directed repair occurs. In some embodiments, homology-directed repair is performed using an exogenously introduced DNA repair template. In some embodiments, exogenously introduced DNA repair template is single-stranded. In some embodiments, exogenously introduced DNA repair template is double-stranded.

In some embodiments, the Cas protein (e.g., Cas9 or Cpf1) is complexed with at least one ribonucleic acid. In some embodiments, the Cas protein (e.g., Cas9) is complexed with multiple ribonucleic acids. In some embodiments, the multiple ribonucleic acids are selected to minimize hybridization with nucleic acid sequences other than the target polynucleotide sequence (e.g., multiple alterations of a single target polynucleotide sequence). In some embodiments, the multiple ribonucleic acids are selected to minimize hybridization with nucleic acid sequences other than the target polynucleotide sequences (e.g., one or more alterations of multiple target polynucleotide sequences). In some embodiments, each of the multiple ribonucleic acids hybridize to target motifs that contain at least two mismatches when compared with all other genomic nucleotide sequences in the cell. In some embodiments, each of the multiple ribonucleic acids hybridize to target motifs that contain at least one mismatch when compared with all other genomic nucleotide sequences in the cell. In some embodiments, each of the multiple ribonucleic acids are designed to hybridize to target motifs immediately adjacent to deoxyribonucleic acid motifs recognized by the Cas protein. In some embodiments, each of the multiple ribonucleic acids are designed to hybridize to target motifs immediately adjacent to deoxyribonucleic acid motifs recognized by the Cas protein which flank mutant alleles located between the target motifs.

In some embodiments, the Cas protein (e.g., Cpf1) is complexed with a single ribonucleic acid. In some embodiments, the ribonucleic acid is selected to minimize hybridization with a nucleic acid sequence other than the target polynucleotide sequence (e.g., multiple alterations of a single target polynucleotide sequence). In some embodiments, the ribonucleic acid is selected to minimize hybridization with a nucleic acid sequence other than the target polynucleotide sequences (e.g., one or more alterations of multiple target polynucleotide sequences). In some embodiments, the ribonucleic acid hybridizes to target motifs that contain at least two mismatches when compared with all other genomic nucleotide sequences in the cell. In some embodiments, the ribonucleic acid hybridizes to target motifs that contain at least one mismatch when compared with all other genomic nucleotide sequences in the cell. In some embodiments, the ribonucleic acid is designed to hybridize to target motifs immediately adjacent to deoxyribonucleic acid motifs recognized by the Cas protein. In some embodiments, the ribonucleic acid is designed to hybridize to target motifs immediately adjacent to deoxyribonucleic acid motifs recognized by the Cas protein which flank mutant alleles located between the target motifs.

It should be appreciated that any of the Cas protein or the ribonucleic acids can be expressed from a plasmid. In some embodiments, any of the Cas protein or the ribonucleic acids are expressed using a promoter optimized for increased expression in stem cells (e.g., human stem and/or progenitor cells). In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter.

In some embodiments, the methods of the present invention further comprise selecting cells that express the Cas protein. The present invention contemplates any suitable method for selecting cells. In some embodiments, selecting cells comprises FACS. In some embodiments, FACS is used to select cells which co-express Cas and a fluorescent protein selected from the group consisting of green fluorescent protein and red fluorescent protein.

The present invention contemplates treating and/or preventing a variety of disorders which are associated with expression of a target polynucleotide sequences. It should be appreciated that the methods and compositions described herein can be used to treat or prevent disorders associated with increased expression of a target polynucleotide sequence, as well as decreased expression of a target polynucleotide sequence in a cell. Increased and decreased expression of a target polynucleotide sequence includes circumstances where the expression levels of the target polynucleotide sequence are increased or decreased, respectively, as well as circumstances in which the function and/or level of activity of an expression product of the target polynucleotide sequence increases or decreases, respectively, compared to normal expression and/or activity levels. Those skilled in the art will appreciate that treating or preventing a disorder associated with increased expression of a target polynucleotide sequence can be assessed by determining whether the levels and/or activity of the target polynucleotide sequence (or an expression product thereof) are decreased in a relevant cell after contacting a cell with a composition described herein. The skilled artisan will also appreciate that treating or preventing a disorder associated with decreased expression of a target polynucleotide sequence can be assessed by determining whether the levels and/or activity of the target polynucleotide sequence (or an expression product thereof) are increased in the relevant cell after contacting a cell with a composition described herein.

In some embodiments, the disorder is a genetic disorder. In some embodiments, the disorder is a monogenic disorder. In some embodiments, the disorder is a multigenic disorder. In some embodiments, the disorder is a disorder associated with one or more SNPs. Exemplary disorders associated with one or more SNPs include a complex disease described in U.S. Pat. No. 7,627,436, Alzheimer's disease as described in PCT International Application Publication No. WO/2009/112882, inflammatory diseases as described in U.S. Patent Application Publication No. 2011/0039918, polycystic ovary syndrome as described in U.S. Patent Application Publication No. 2012/0309642, cardiovascular disease as described in U.S. Pat. No. 7,732,139, Huntington's disease as described in U.S. Patent Application Publication No. 2012/0136039, thromboembolic disease as described in European Patent Application Publication No. EP2535424, neurovascular diseases as described in PCT International Application Publication No. WO/2012/001613, psychosis as described in U.S. Patent Application Publication No. 2010/0292211, multiple sclerosis as described in U.S. Patent Application Publication No. 2011/0319288, schizophrenia, schizoaffective disorder, and bipolar disorder as described in PCT International Application Publication No. WO/2006/023719A2, bipolar disorder and other ailments as described in U.S. Patent Application Publication No. U.S. 2011/0104674, colorectal cancer as described in PCT International Application Publication No. WO/2006/104370A1, a disorder associated with a SNP adjacent to the AKT1 gene locus as described in U.S. Patent Application Publication No. U.S. 2006/0204969, an eating disorder as described in PCT International Application Publication No. WO/2003/012143A1, autoimmune disease as described in U.S. Patent Application Publication No. U.S. 2007/0269827, fibrostenosing disease in patients with Crohn's disease as described in U.S. Pat. No. 7,790,370, and Parkinson's disease as described in U.S. Pat. No. 8,187,811, each of which is incorporated herein by reference in its entirety. Other disorders associated with one or more SNPs which can be treated or prevented according to the methods of the present invention will be apparent to the skilled artisan.

In some embodiments, the disorder is human immunodeficiency virus (HIV) infection. In some embodiments, the disorder is acquired immunodeficiency syndrome (AIDS).

The methods of the present invention are capable of altering target polynucleotide sequences in a variety of different cells (e.g., altering B2M to ablate MHC class I surface expression and altering one or more additional target polynucleotide sequences associated with a disorder in which altering the target polynucleotide sequences would be beneficial). In some embodiments, the methods of the present invention are used to alter target polynucleotide sequences in cells ex vivo for subsequent introduction into a subject. In some embodiments, the cell is a peripheral blood cell. In some embodiments, the cell is a stem cell or a pluripotent cell. In some embodiments, the cell is a hematopoietic stem cell. In some embodiments, the cell is a CD34+ cell. In some embodiments, the cell is a CD34+ mobilized peripheral blood cell. In some embodiments, the cell is a CD34+ cord blood cell. In some embodiments, the cell is a CD34+ bone marrow cell. In some embodiments, the cell is a CD34+CD38-Lineage-CD90+CD45RA− cell. In some embodiments, the cell is a CD4+ cell. In some embodiments, the cell is a CD4+ T cell. In some embodiments, the cell is a hepatocyte. In some embodiments, the cell is a human pluripotent cell. In some embodiments, the cell is a primary human cell. In some embodiments, the cell is a primary CD34+ cell. In some embodiments, the cell is a primary CD34+ hematopoietic progenitor cell (HPC). In some embodiments, the cell is a primary CD4+ cell. In some embodiments, the cell is a primary CD4+ T cell. In some embodiments, the cell is an autologous primary cell. In some embodiments, the cell is an autologous primary somatic cell. In some embodiments, the cell is an allogeneic primary cell. In some embodiments, the cell is an allogeneic primary somatic cell. In some embodiments, the cell is a nucleated cell. In some embodiments, the cell is a non-transformed cell. In some embodiments, the cell is a human choriocarcinoma cell. In some embodiments, the cell is a JEG-3 cell. In some embodiments, the cell is a monocyte cell. In some embodiments, the cell is a Thp-1 cell. In some embodiments, the cell is not a cancer cell. In some embodiments, the cell is not a tumor cell. In some embodiments, the cell is not a transformed cell.

The present invention also provides compositions comprising Cas proteins of the present invention or functional portions thereof, nucleic acids encoding the Cas proteins or functional portions thereof, and ribonucleic acid sequences which direct Cas proteins to and hybridize to target motifs of target polynucleotides in a cell. In some aspects, disclosed herein are compositions comprising a nucleic acid sequence encoding a Cas 9 protein, a first ribonucleic acid targeting a sequence of SEQ ID NO: 16; and a second ribonucleic acid targeting a sequence of SEQ ID NO: 21. In some aspects, disclosed herein are compositions comprising a chimeric nucleic acid comprising a nucleic acid sequence encoding a Cas protein; a first ribonucleic acid targeting a sequence of SEQ ID NO: 16; and a second ribonucleic acid targeting a sequence of SEQ ID NO:21. In some aspects, disclosed herein are compositions comprising a nucleic acid sequence encoding a Cpf1 protein and a ribonucleic acid targeting a sequence selected from the group consisting of SEQ ID NOs: 419-880. In some aspects, disclosed herein are compositions comprising a chimeric nucleic acid comprising a nucleic acid sequence encoding a Cas protein and a ribonucleic acid targeting a sequence selected from the group consisting of SEQ ID NOs: 419-880.

In some embodiments, the composition comprises a nucleic acid sequence encoding a detectable marker.

In some embodiments, the first ribonucleic acid comprises a sequence with a single nucleotide mismatch to a sequence selected from the group consisting of SEQ ID NOs: 9-23 and 881-2609. In some embodiments, the first ribonucleic acid comprises a sequence with a two nucleotide mismatch to a sequence selected from the group consisting of SEQ ID NOs: 9-23 and 881-2609.

In some embodiments, the second ribonucleic acid comprises a sequence with a single nucleotide mismatch to a sequence selected from the group consisting of SEQ ID NOs: 9-23 and 881-2609. In some embodiments, the second ribonucleic acid comprises a sequence with a two nucleotide mismatch to a sequence selected from the group consisting of SEQ ID NOs: 9-23 and 881-2609.

In some embodiments, a ribonucleic acid comprises a sequence with a single nucleotide mismatch to a sequence selected from the group consisting of SEQ ID NOs: 419-880. In some embodiments, the ribonucleic acid comprises a sequence with a two nucleotide mismatch to a sequence selected from the group consisting of SEQ ID NOs: 419-880.

In some embodiments, the composition includes at least one additional ribonucleic acid sequences for altering a target polynucleotide sequence. In some embodiments, the composition includes at least two additional ribonucleic acid sequences for altering a target polynucleotide sequence. In some embodiments, the composition includes at least three additional ribonucleic acid sequences for altering a target polynucleotide sequence. In some embodiments, the composition includes at least four additional ribonucleic acid sequences for altering a target polynucleotide sequence.

In some embodiments, the composition includes at least one to two additional ribonucleic acid sequences for altering a target CCR5 polynucleotide sequence. In some embodiments, the at least one to two additional ribonucleic acid sequences is a ribonucleic acid sequence for altering a target CCR5 polynucleotide selected from the group consisting of any two ribonucleic acid sequences of SEQ ID NOs: 2-8. In some embodiments, the at least one to two additional ribonucleic acid sequences is a ribonucleic acid sequence for altering a target CCR5 polynucleotide selected from the group consisting of any two ribonucleic acid sequences disclosed in FIG. 1 of WIPO Publication No. WO2014/165825, incorporated herein by reference in its entirety. In some embodiments, the composition includes at least one to two additional ribonucleic acid sequences for altering a target CCR5 polynucleotide having a sequence with a single nucleotide mismatch to a sequence selected from the ribonucleic acid sequences of FIG. 1 in WIPO Publication No. WO2014/165825. In some embodiments, the composition includes at least one to two additional ribonucleic acid sequences for altering a target CCR5 polynucleotide having a sequence with a two nucleotide mismatches to a sequence selected from the ribonucleic acid sequences of FIG. 1 in WIPO Publication No. WO2014/165825.

In some embodiments, the composition includes at least one to two additional ribonucleic acid sequences for altering a target CXCR4 polynucleotide sequence. In some embodiments, the at least one to two additional ribonucleic acid sequences is a ribonucleic acid sequence for altering a target CXCR4 polynucleotide selected from the group consisting of any one to two ribonucleic acid sequences disclosed in FIG. 2 of WIPO Publication No. WO2014/165825, incorporated herein by reference in its entirety. In some embodiments, the composition includes at least one to two additional ribonucleic acid sequences for altering a target CXCR4 polynucleotide having a sequence with a single nucleotide mismatch to a sequence selected from the ribonucleic acid sequences of FIG. 2 in WIPO Publication No. WO2014/165825. In some embodiments, the composition includes at least one to two additional ribonucleic acid sequences for altering a target CXCR4 polynucleotide having a sequence with a two nucleotide mismatches to a sequence selected from the ribonucleic acid sequences of FIG. 2 in WIPO Publication No. WO2014/165825.

In some embodiments, at least one of the ribonucleic acids in the composition is a modified ribonucleic acid as described herein (e.g., a synthetic, modified ribonucleic acid, e.g., comprising one to two modified nucleotides selected from the group consisting of pseudouridine, 5-methylcytodine, 2-thio-uridine, 5-methyluridine-5′-triphosphate, 4-thiouridine-5′-triphosphate, 5,6-dihydrouridine-5′-triphosphate, and 5-azauridine-5′-triphosphate, or any other modified nucleotides or modifications described herein).

In some embodiments, a composition of the present invention comprises a nucleic acid sequence encoding a Cas protein. In some embodiments, a composition of the present invention comprises nucleic acid sequence encoding Cas9 protein or a functional portion thereof. In some embodiments, a composition of the present invention comprises nucleic acid sequence encoding Cpf1 protein or a functional portion thereof.

In some embodiments, the nucleic acid encoding the Cas protein (e.g., Cas9 or Cpf1) comprises a modified ribonucleic acid as described herein (e.g., a synthetic, modified mRNA described herein, e.g., comprising at least one modified nucleotide selected from the group consisting of pseudouridine, 5-methylcytodine, 2-thio-uridine, 5-methyluridine-5′-triphosphate, 4-thiouridine-5′-triphosphate, 5,6-dihydrouridine-5′-triphosphate, and 5-azauridine-5′-triphosphate or any other modified nucleotides or modifications described herein).

In some embodiments, a composition of the present invention comprises a nucleic acid sequence encoding a fluorescent protein selected from the group consisting of green fluorescent protein and red fluorescent protein. In some embodiments, a composition of the present invention comprises a promoter operably linked to the chimeric nucleic acid. In some embodiments, the promoter is optimized for increased expression in human cells. In some embodiments, the promoter is optimized for increased expression in human stem cells. In some embodiments, the promoter is optimized for increased expression in primary human cells. In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter.

In some embodiments, the Cas protein comprises a Cas9 protein or a functional portion thereof. In some embodiments, the Cas protein comprises a Cpf1 protein or a functional portion thereof.

The present invention also provides kits for practicing any of the methods of the present invention, as well as kits comprising the compositions of the present invention, and instructions for using the kits for altering target polynucleotide sequences in a cell.

Administering Cells

In some aspects, the invention provides a method of administering cells to a subject in need of such cells, the method comprising: (a) contacting a cell or population of cells ex vivo with a Cas protein and two ribonucleic acids which direct Cas protein to and hybridize to a target polynucleotide sequence encoding B2M in the cell or population of cells, wherein the target polynucleotide sequence is cleaved; and (b) administering the resulting cells from (a) to a subject in need of such cells.

In some aspects, the invention provides a method of administering cells to a subject in need of such cells, the method comprising: (a) contacting a cell or population of cells ex vivo with a Cas protein and at least one ribonucleic acid which directs Cas protein to and hybridizes to a target polynucleotide sequence encoding B2M in the cell or population of cells, wherein the target polynucleotide sequence is cleaved; and (b) administering the resulting cells from (a) to a subject in need of such cells.

In some aspects, the invention provides a method of administering cells to a subject in need of such cells, the method comprising: (a) contacting a cell or population of cells ex vivo with a Cas protein and one ribonucleic acid which directs Cas protein to and hybridizes to a target polynucleotide sequence encoding B2M in the cell or population of cells, wherein the target polynucleotide sequence is cleaved; and (b) administering the resulting cells from (a) to a subject in need of such cells.

In some aspects, the invention provides a method of administering cells to a subject in need of such cells, the method comprising: (a) contacting a cell or population of cells ex vivo with (i) a Cas protein, (ii) at least two ribonucleic acids which direct Cas protein to and hybridize to a target polynucleotide sequence encoding B2M in the cell or population of cells, and (iii) at least two additional ribonucleic acids which direct Cas protein to and hybridize to a target polynucleotide sequence in the cell or population of cells, wherein the target polynucleotide sequences are cleaved; and (b) administering the resulting cell or cells from (a) to a subject in need of such cells.

In some aspects, the invention provides a method of administering cells to a subject in need of such cells, the method comprising: (a) contacting a cell or population of cells ex vivo with (i) a Cas protein, (ii) at least one ribonucleic acid which directs Cas protein to and hybridizes to a target polynucleotide sequence encoding B2M in the cell or population of cells, and (iii) at least one additional ribonucleic acid which directs Cas protein to and hybridizes to a target polynucleotide sequence in the cell or population of cells, wherein the target polynucleotide sequences are cleaved; and (b) administering the resulting cell or cells from (a) to a subject in need of such cells.

In some aspects, the invention provides a method of administering cells to a subject in need of such cells, the method comprising: (a) contacting a cell or population of cells ex vivo with (i) a Cas protein, (ii) one ribonucleic acid which directs Cas protein to and hybridizes to a target polynucleotide sequence encoding B2M in the cell or population of cells, and (iii) one additional ribonucleic acid which directs Cas protein to and hybridizes to a target polynucleotide sequence in the cell or population of cells, wherein the target polynucleotide sequences are cleaved; and (b) administering the resulting cell or cells from (a) to a subject in need of such cells.

B2M is an accessory chain of the MHC class I proteins which is necessary for the expression of MHC class I proteins on the surface of cells. It is believed that engineering cells (e.g., mutant cells) devoid of surface MHC class I may reduce the likelihood that the engineered cells will be detected by cytotoxic T cells when the engineered cells are administered to a host. Accordingly, in some embodiments, cleavage of the target polynucleotide sequence encoding B2M in the cell or population of cells reduces the likelihood that the resulting cell or cells will trigger a host immune response when the cells are administered to the subject.

In some aspects, the invention provides a method of reducing the likelihood that cells administered to a subject will trigger a host immune response in the subject, the method comprising: (a) contacting a cell or population of cells ex vivo with a Cas protein and two ribonucleic acids which direct Cas protein to and hybridize to a target polynucleotide sequence encoding B2M in the cell or population of cells, wherein the target polynucleotide sequence encoding B2M is cleaved, thereby reducing the likelihood that cells administered to the subject will trigger a host immune response in the subject; and (b) administering the resulting cells from (a) to a subject in need of such cells.

In some aspects, the invention provides a method of reducing the likelihood that cells administered to a subject will trigger a host immune response in the subject, the method comprising: (a) contacting a cell or population of cells ex vivo with a Cas protein and at least one ribonucleic acid which directs Cas protein to and hybridizes to a target polynucleotide sequence encoding B2M in the cell or population of cells, wherein the target polynucleotide sequence encoding B2M is cleaved, thereby reducing the likelihood that cells administered to the subject will trigger a host immune response in the subject; and (b) administering the resulting cells from (a) to a subject in need of such cells.

In some aspects, the invention provides a method of reducing the likelihood that cells administered to a subject will trigger a host immune response in the subject, the method comprising: (a) contacting a cell or population of cells ex vivo with (i) a Cas protein, (ii) at least two ribonucleic acids which direct Cas protein to and hybridize to a target polynucleotide sequence encoding B2M in the cell or population of cells, wherein the target polynucleotide sequence encoding B2M in the cell or population of cells is cleaved, thereby reducing the likelihood that the cell or population of cells will trigger a host immune response in the subject, and (iii) at least two additional ribonucleic acids which direct Cas protein to and hybridize to a target polynucleotide sequence in the cell or population of cells, wherein the target polynucleotide sequence is cleaved; and (b) administering the resulting cell or cells from (a) to a subject in need of such cells.

In some aspects, the invention provides a method of reducing the likelihood that cells administered to a subject will trigger a host immune response in the subject, the method comprising: (a) contacting a cell or population of cells ex vivo with (i) a Cas protein, (ii) at least one ribonucleic acid which directs Cas protein to and hybridizes to a target polynucleotide sequence encoding B2M in the cell or population of cells, wherein the target polynucleotide sequence encoding B2M in the cell or population of cells is cleaved, thereby reducing the likelihood that the cell or population of cells will trigger a host immune response in the subject, and (iii) at least one additional ribonucleic acid which directs Cas protein to and hybridizes to a target polynucleotide sequence in the cell or population of cells, wherein the target polynucleotide sequence is cleaved; and (b) administering the resulting cell or cells from (a) to a subject in need of such cells.

It is contemplated that the methods of administering cells can be adapted for any purpose in which administering such cells is desirable. In some embodiments, the subject in need of administration of cells is suffering from a disorder. For example, the subject may be suffering from a disorder in which the particular cells are decreased in function or number, and it may be desirable to administer functional cells obtained from a healthy or normal individual in which the particular cells are functioning properly and to administer an adequate number of those healthy cells to the individual to restore the function provided by those cells (e.g., hormone producing cells which have decreased in cell number or function, immune cells which have decreased in cell number or function, etc.). In such instances, the healthy cells can be engineered to decrease the likelihood of host rejection of the healthy cells. In some embodiments, the disorder comprises a genetic disorder. In some embodiments, the disorder comprises an infection. In some embodiments, the disorder comprises HIV or AIDs. In some embodiments, the disorder comprises cancer.

In some aspects, the disclosure provides a method for allogeneic administration of cells to a subject in need of such cells. The method comprises ex vivo contacting of a population of primary cells obtained from a first subject with a Cas protein or a nucleic acid encoding a Cas protein and a pair of ribonucleic acids targeting SEQ ID NO: 16 and SEQ ID NO: 21, thereby editing the genome of at least 25% of the primary cells in the population to delete a contiguous stretch of genomic DNA comprising base pairs 5109 to 7331 (SEQ ID NO: 1) in the B2M gene on chromosome 15, wherein the genomically edited cells lack surface expression of MHC class I molecules, and then administering the genomically edited cells to a second subject in need of such cells.

In some aspects, the disclosure provides a method for allogeneic administration of cells to a subject in need of such cells. The method comprises ex vivo contacting of a population of primary cells obtained from a first subject with a Cas protein or a nucleic acid encoding a Cas protein and a ribonucleic acid targeting a sequence selected from the group of consisting of SEQ ID NOs: 419-880, thereby editing the genome of at least 25% of the primary cells in the population to delete a contiguous stretch of genomic DNA comprising base pairs 5109 to 7331 (SEQ ID NO: 1) in the B2M gene on chromosome 15, wherein the genomically edited cells lack surface expression of MHC class I molecules, and then administering the genomically edited cells to a second subject in need of such cells.

As noted above, any population of primary cells can be edited to delete SEQ ID NO: 1 using the method. Examples of such cells include, a stem cell, a pluripotent cell, a progenitor cells, a hematopoietic stem and/or progenitor cells, a CD34+ cell, a CD34+ mobilized peripheral blood cell, a CD34+ cord blood cell, a CD34+ bone marrow cell, a CD34+CD38-Lineage-CD90+CD45RA− cell, a CD34+ hematopoietic stem and/or progenitor cell, a CD4+ T cell, a hepatocyte, a somatic cell, and a non-transformed cell.

The population of cells can be sorted (e.g., using FACS) prior to administering the cells to select for cells in which their genome has been edited to comprise deletion of SEQ ID NO: 1. The sorted cells can then be expanded to an amount of cells needed for transplantation for the particular disorder for which the second subject is in need of such cells. For example, the second subject might be suffering from, being treated for, diagnosed with, at risk of developing, or suspected of having, a disorder selected from the group consisting of a genetic disorder, an infection, and cancer. In the situation in which the subject is suffering from an infection, such as HIV or AIDS, the subject might be in need of CD34+ HPSC cells. In such example, the first subject (a CD34+ HPSC cell donor) can undergo an apheresis procedure in which bone marrow HPSC cells are mobilized using an HPSC mobilization regimen (e.g., G-CSF), and then those mobilized cells are harvested via apheresis. CD34+ HPSC cells can then be sorted from the mobilized peripheral blood cells. Once a suitable number of CD34+ HSPC cells is obtained, such cells can be modified using the pair of gRNA sequences and the CRISPR/Cas systems disclosed herein to ablate MHC class I molecule surface expression in at least 25% of the population of primary CD34+ HPSC cells from the first subject. The population of cells can then be sorted to select for mutant CD34+ HPSC cells comprising deletion of SEQ ID NO: 1, and then those mutant cells can optionally be expanded for subsequent administration to a subject.

In some embodiments, the method can include, prior to the step of administering, contacting the genomically modified cells with Cas protein and one or more guide RNA sequences targeting one or more additional target polynucleotides that are associated with the disorder for which the second subject (i.e., recipient) is in need of such cells. In the HIV example above, the genomically modified cells can be contacted with Cas protein and one or more guide RNA sequences targeting the CCR5 and/or CXCR4 genes, thereby editing the genome of the genomically modified cells to eliminate or reduce surface expression of CCR5 and/or CXCR4. In this way, the mutant cells would comprise deletion of SEQ ID NO: 1 from the B2M gene and altered expression of CCR5 and/or CXCR4. Such cells would be beneficial for administration to the second subject (e.g., suffering from HIV or AIDS) as they would eliminate or reduce the likelihood of an unwanted host immune response due to lack of MHC class I molecule surface expression, and exhibit little or no susceptibility to HIV infection due to the lack of CCR5 and/or CXCR4 surface expression.

As used herein "nucleic acid," in its broadest sense, includes any compound and/or substance that comprise a polymer of nucleotides linked via a phosphodiester bond. Exemplary nucleic acids include ribonucleic acids (RNAs), deoxyribonucleic acids (DNAs), threose nucleic acids (TNAs), glycol nucleic acids (GNAs), peptide nucleic acids (PNAs), locked nucleic acids (LNAs) or hybrids thereof. They may also include RNAi-inducing agents, RNAi agents, siRNAs, shRNAs, miRNAs, antisense RNAs, ribozymes, catalytic DNA, tRNA, RNAs that induce triple helix formation, aptamers, vectors, etc. In some embodiments, the nucleic acid encoding the Cas protein is an mRNA. In some embodiments, the Cas protein is encoded by a modified nucleic acid (e.g., a synthetic, modified mRNA described herein).

The present invention contemplates the use of any nucleic acid modification available to the skilled artisan. The nucleic acids of the present invention can include any number of modifications. In some embodiments, the nucleic acid comprises one or more modifications selected from the group consisting of pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl)adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof.

Preparation of modified nucleosides and nucleotides used in the manufacture or synthesis of modified RNAs of the present invention can involve the protection and deprotection of various chemical groups. The need for protection and deprotection, and the selection of appropriate protecting groups can be readily determined by one skilled in the art.

The chemistry of protecting groups can be found, for example, in Greene, et al., Protective Groups in Organic Synthesis, 2d. Ed., Wiley & Sons, 1991, which is incorporated herein by reference in its entirety.

Modified nucleosides and nucleotides can be prepared according to the synthetic methods described in Ogata et al. Journal of Organic Chemistry 74:2585-2588, 2009; Purmal et al. Nucleic Acids Research 22(1): 72-78, 1994; Fukuhara et al. Biochemistry 1(4): 563-568, 1962; and Xu et al. Tetrahedron 48(9): 1729-1740, 1992, each of which are incorporated by reference in their entirety.

Modified nucleic acids (e.g., ribonucleic acids) need not be uniformly modified along the entire length of the molecule. Different nucleotide modifications and/or backbone structures may exist at various positions in the nucleic acid. One of ordinary skill in the art will appreciate that the nucleotide analogs or other modification(s) may be located at any position(s) of a nucleic acid such that the function of the nucleic acid is not substantially decreased. A modification may also be a 5' or 3' terminal modification. The nucleic acids may contain at a minimum one and at maximum 100% modified nucleotides, or any intervening percentage, such as at least 50% modified nucleotides, at least 80% modified nucleotides, or at least 90% modified nucleotides.

In some embodiments, at least one ribonucleic acid is a modified ribonucleic acid. In some embodiments, at least one of the one to two ribonucleic acids is a modified ribonucleic acid. In some embodiments, each of the one to two ribonucleic acids is a modified ribonucleic acid. In some embodiments, at least one of the multiple ribonucleic acids is a modified ribonucleic acid. In some embodiments, a plurality of the multiple ribonucleic acids are modified. In some embodiments, each of the multiple ribonucleic acids are modified. Those skilled in the art will appreciate that the modified ribonucleic acids can include one or more of the nucleic acid modification described herein.

In some aspects, provided herein are synthetic, modified RNA molecules encoding polypeptides, where the synthetic, modified RNA molecules comprise one or more modifications, such that introducing the synthetic, modified RNA molecules to a cell results in a reduced innate immune response relative to a cell contacted with synthetic RNA molecules encoding the polypeptides not comprising the one or more modifications. In some embodiments, the Cas protein comprises a synthetic, modified RNA molecule encoding a Cas protein. In some embodiments, the Cas protein comprises a synthetic, modified RNA molecule encoding a Cas9 protein. In some embodiments, the Cas protein comprises a synthetic, modified RNA molecule encoding a Cpf1 protein.

The synthetic, modified RNAs described herein include modifications to prevent rapid degradation by endo- and exo-nucleases and to avoid or reduce the cell's innate immune or interferon response to the RNA. Modifications include, but are not limited to, for example, (a) end modifications, e.g., 5' end modifications (phosphorylation dephosphorylation, conjugation, inverted linkages, etc.), 3' end modifications (conjugation, DNA nucleotides, inverted linkages, etc.), (b) base modifications, e.g., replacement with modified bases, stabilizing bases, destabilizing bases, or bases that base pair with an expanded repertoire of partners, or conjugated bases, (c) sugar modifications (e.g., at the 2' position or 4' position) or replacement of the sugar, as well as (d) internucleoside linkage modifications, including modification or replacement of the phosphodiester linkages. To the extent that such modifications interfere with translation (i.e., results in a reduction of 50% or more in translation relative to the lack of the modification—e.g., in a rabbit reticulocyte in vitro translation assay), the modification is not suitable for the methods and compositions described herein. Specific examples of synthetic, modified RNA compositions useful with the methods described herein include, but are not limited to, RNA molecules containing modified or non-natural internucleoside linkages. Synthetic, modified RNAs having modified internucleoside linkages include, among others, those that do not have a phosphorus atom in the internucleoside linkage. In other embodiments, the synthetic, modified RNA has a phosphorus atom in its internucleoside linkage(s).

Non-limiting examples of modified internucleoside linkages include phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, each of which is herein incorporated by reference in its entirety.

Modified internucleoside linkages that do not include a phosphorus atom therein have internucleoside linkages that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of modified oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, each of which is herein incorporated by reference in its entirety.

Some embodiments of the synthetic, modified RNAs described herein include nucleic acids with phosphorothioate internucleoside linkages and oligonucleosides with heteroatom internucleoside linkage, and in particular —$CH_2$—NH—$CH_2$-, $CH_2$-N($CH_3$)-O-$CH_2$-[known as a methylene (methylimino) or MMI], $CH_2$-O—N($CH_3$)-$CH_2$-, $CH_2$-N($CH_3$)-N($CH_3$)-$CH_2$- and N($CH_3$)-$CH_2$-$CH_2$- [wherein the native phosphodiester internucleoside linkage is represented as —O—P—O—$CH_2$-] of the above-referenced U.S. Pat. No. 5,489,677, and the amide backbones of the above-referenced U.S. Pat. No. 5,602,240, both of which are herein incorporated by reference in their entirety. In some embodiments, the nucleic acid sequences featured herein have morpholino backbone structures of the above-referenced U.S. Pat. No. 5,034,506, herein incorporated by reference in its entirety.

Synthetic, modified RNAs described herein can also contain one or more substituted sugar moieties. The nucleic acids featured herein can include one of the following at the 2' position: H (deoxyribose); OH (ribose); F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted C1 to C10 alkyl or C2 to C10 alkenyl and alkynyl. Exemplary modifications include O[($CH_2$)nO]m$CH_3$, O($CH_2$)·nO$CH_3$, O($CH_2$)n$NH_2$, O($CH_2$)n$CH_3$, O($CH_2$)nO$NH_2$, and O($CH_2$)nON[($CH_2$)n$CH_3$)]2, where n and m are from 1 to about 10. In some embodiments, synthetic, modified RNAs include one of the following at the 2' position: C1 to C10 lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, a reporter group, an intercalator, a group for improving the pharmacokinetic properties of an RNA, or a group for improving the pharmacodynamic properties of a synthetic, modified RNA, and other substituents having similar properties. In some embodiments, the modification includes a 2' methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O($CH_2$)2ON($CH_3$)2 group, also known as 2'-DMAOE, and 2'-dimethylaminoethoxyethoxy (also known in the art as 2'-O-dimethylaminoethoxyethyl or 2'-DMAEOE), i.e., 2'-O-CH2-OCH2-N(CH2)2.

Other modifications include 2'-methoxy (2'-OCH3), 2'-aminopropoxy (2'-OCH2CH2CH2NH2) and 2'-fluoro (2'-F). Similar modifications can also be made at other positions on the nucleic acid sequence, particularly the 3' position of the sugar on the 3' terminal nucleotide or in 2'-5' linked nucleotides and the 5' position of 5' terminal nucleotide. A synthetic, modified RNA can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

As non-limiting examples, synthetic, modified RNAs described herein can include at least one modified nucleoside including a 2'-O-methyl modified nucleoside, a nucleoside comprising a 5' phosphorothioate group, a 2'-amino-modified nucleoside, 2'-alkyl-modified nucleoside, morpholino nucleoside, a phosphoramidate or a non-natural base comprising nucleoside, or any combination thereof.

In some embodiments of this aspect and all other such aspects described herein, the at least one modified nucleoside is selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxyuridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I).

Alternatively, a synthetic, modified RNA can comprise at least two modified nucleosides, at least 3, at least 4, at least 5, at least 6, at least 7, at least 8, at least 9, at least 10, at least 15, at least 20 or more, up to the entire length of the nucleotide. At a minimum, a synthetic, modified RNA molecule comprising at least one modified nucleoside comprises a single nucleoside with a modification as described herein. It is not necessary for all positions in a given synthetic, modified RNA to be uniformly modified, and in fact more than one of the aforementioned modifications can be incorporated in a single synthetic, modified RNA or even at a single nucleoside within a synthetic, modified RNA. However, it is preferred, but not absolutely necessary, that each occurrence of a given nucleoside in a molecule is modified (e.g., each cytosine is a modified cytosine e.g., 5mC). However, it is also contemplated that different occurrences of the same nucleoside can be modified in a different way in a given synthetic, modified RNA molecule (e.g., some cytosines modified as 5mC, others modified as 2'-O-methylcytidine or other cytosine analog). The modifications need not be the same for each of a plurality of modified nucleosides in a synthetic, modified RNA. Furthermore, in some embodiments of the aspects described herein, a synthetic, modified RNA comprises at least two different modified nucleosides. In some such preferred embodiments of the aspects described herein, the at least two different modified nucleosides are 5-methylcytidine and pseudouridine. A synthetic, modified RNA can also contain a mixture of both modified and unmodified nucleosides.

As used herein, "unmodified" or "natural" nucleosides or nucleobases include the purine bases adenine (A) and guanine (G), and the pyrimidine bases thymine (T), cytosine (C) and uracil (U). In some embodiments, a synthetic, modified RNA comprises at least one nucleoside ("base") modification or substitution. Modified nucleosides include other synthetic and natural nucleobases such as inosine, xanthine, hypoxanthine, nubularine, isoguanisine, tubercidine, 2-(halo)adenine, 2-(alkyl)adenine, 2-(propyl)adenine, 2 (amino)adenine, 2-(aminoalkyl)adenine, 2 (aminopropyl) adenine, 2 (methylthio) N6 (isopentenyl)adenine, 6 (alkyl) adenine, 6 (methyl)adenine, 7 (deaza)adenine, 8 (alkenyl) adenine, 8-(alkyl)adenine, 8 (alkynyl)adenine, 8 (amino) adenine, 8-(halo)adenine, 8-(hydroxyl)adenine, 8 (thioalkyl) adenine, 8-(thiol)adenine, N6-(isopentyl)adenine, N6 (methyl)adenine, N6, N6 (dimethyl)adenine, 2-(alkyl)guanine, 2 (propyl)guanine, 6-(alkyl)guanine, 6 (methyl)guanine, 7 (alkyl)guanine, 7 (methyl)guanine, 7 (deaza)guanine, 8 (alkyl)guanine, 8-(alkenyl)guanine, 8 (alkynyl)guanine, 8-(amino)guanine, 8 (halo)guanine, 8-(hydroxyl)guanine, 8 (thioalkyl)guanine, 8-(thiol)guanine, N (methyl)guanine, 2-(thio)cytosine, 3 (deaza) 5 (aza)cytosine, 3-(alkyl)cytosine, 3 (methyl)cytosine, 5-(alkyl)cytosine, 5-(alkynyl)cytosine, 5 (halo)cytosine, 5 (methyl)cytosine, 5 (propynyl) cytosine, 5 (propynyl)cytosine, 5 (trifluoromethyl)cytosine, 6-(azo)cytosine, N4 (acetyl)cytosine, 3 (3 amino-3 carboxypropyl)uracil, 2-(thio)uracil, 5 (methyl) 2 (thio)uracil, 5 (methylaminomethyl)-2 (thio)uracil, 4-(thio)uracil, 5 (methyl) 4 (thio)uracil, 5 (methylaminomethyl)-4 (thio)uracil, 5 (methyl) 2,4 (dithio)uracil, 5 (methylaminomethyl)-2,4 (dithio)uracil, 5 (2-aminopropyl)uracil, 5-(alkyl)uracil, 5-(alkynyl)uracil, 5-(allylamino)uracil, 5 (aminoallyl)uracil, 5 (aminoalkyl)uracil, 5 (guanidiniumalkyl)uracil, 5 (1,3-diazole-1-alkyl)uracil, 5-(cyanoalkyl)uracil, 5-(dialkylaminoalkyl)uracil, 5 (dimethylaminoalkyl)uracil, 5-(halo)uracil, 5-(methoxy)uracil, uracil-5 oxyacetic acid, 5 (methoxycarbonylmethyl)-2-(thio)uracil, 5 (methoxycarbonyl-methyl) uracil, 5 (propynyl)uracil, 5 (propynyl)uracil, 5 (trifluoromethyl)uracil, 6 (azo)uracil, dihydrouracil, N3 (methyl)uracil, 5-uracil (i.e., pseudouracil), 2 (thio)pseudouracil, 4 (thio) pseudouracil, 2,4-(dithio)psuedouracil, 5-(alkyl)pseudouracil, 5-(methyl)pseudouracil, 5-(alkyl)-2-(thio)pseudouracil, 5-(methyl)-2-(thio)pseudouracil, 5-(alkyl)-4 (thio)pseudouracil, 5-(methyl)-4 (thio)pseudouracil, 5-(alkyl)-2,4 (dithio) pseudouracil, 5-(methyl)-2,4 (dithio)pseudouracil, 1 substituted pseudouracil, 1 substituted 2(thio)-pseudouracil, 1 substituted 4 (thio)pseudouracil, 1 substituted 2,4-(dithio) pseudouracil, 1 (aminocarbonylethylenyl)-pseudouracil, 1 (aminocarbonylethylenyl)-2(thio)-pseudouracil, 1 (aminocarbonylethylenyl)-4 (thio)pseudouracil, 1 (aminocarbonylethylenyl)-2,4-(dithio)pseudouracil, 1 (aminoalkylaminocarbonylethylenyl)-pseudouracil, 1 (aminoalkylaminocarbonylethylenyl)-2(thio)-pseudouracil, 1 (aminoalkylaminocarbonylethylenyl)-4 (thio)pseudouracil, 1 (aminoalkylaminocarbonylethylenyl)-2,4-(dithio) pseudouracil, 1,3-(diaza)-2-(oxo)-phenoxazin-1-yl, 1-(aza)-2-(thio)-3-(aza)-phenoxazin-1-yl, 1,3-(diaza)-2-(oxo)-phenthiazin-1-yl, 1-(aza)-2-(thio)-3-(aza)-phenthiazin-1-yl, 7-substituted 1,3-(diaza)-2-(oxo)-phenoxazin-1-yl, 7-substituted 1-(aza)-2-(thio)-3-(aza)-phenoxazin-1-yl, 7-substituted 1,3-(diaza)-2-(oxo)-phenthiazin-1-yl, 7-substituted 1-(aza)-2-(thio)-3-(aza)-phenthiazin-1-yl, 7-(aminoalkylhydroxy)-1,3-(diaza)-2-(oxo)-phenoxazin-1-yl, 7-(aminoalkylhydroxy)-1-(aza)-2-(thio)-3-(aza)-phenoxazin-1-yl, 7-(aminoalkylhydroxy)-1,3-(diaza)-2-(oxo)-phenthiazin-1- yl, 7-(aminoalkylhydroxy)-1-(aza)-2-(thio)-3-(aza)-phenthiazin-1-yl, 7-(guanidiniumalkylhydroxy)-1,3-(diaza)-2-(oxo)-phenoxazin-1-yl, 7-(guanidiniumalkylhydroxy)-1-(aza)-2-(thio)-3-(aza)-phenoxazin-1-yl, 7-(guanidiniumalkylhydroxy)-1,3-(diaza)-2-(oxo)-phenthiazin-1-yl, 7-(guanidiniumalkylhydroxy)-1-(aza)-2-(thio)-3-(aza)-phenthiazin-1-yl, 1,3,5-(triaza)-2,6-(dioxa)-naphthalene, inosine, xanthine, hypoxanthine, nubularine, tubercidine, isoguanisine, inosinyl, 2-aza-inosinyl, 7-deaza-inosinyl, nitroimidazolyl, nitropyrazolyl, nitrobenzimidazolyl, nitroindazolyl, aminoindolyl, pyrrolopyrimidinyl, 3-(methyl)isocarbostyrilyl, 5-(methyl)isocarbostyrilyl, 3-(methyl)-7-(propynyl)isocarbostyrilyl, 7-(aza)indolyl, 6-(methyl)-7-(aza)indolyl, imidizopyridinyl, 9-(methyl)-imidizopyridinyl, pyrrolopyrizinyl, isocarbostyrilyl, 7-(propynyl)isocarbostyrilyl, propynyl-7-(aza)indolyl, 2,4,5-(trimethyl)phenyl, 4-(methyl)indolyl, 4,6-(dimethyl)indolyl, phenyl, napthalenyl, anthracenyl, phenanthracenyl, pyrenyl, stilbenzyl, tetracenyl, pentacenyl, difluorotolyl, 4-(fluoro)-6-(methyl)benzimidazole, 4-(methyl)benzimidazole, 6-(azo) thymine, 2-pyridinone, 5 nitroindole, 3 nitropyrrole, 6-(aza) pyrimidine, 2 (amino)purine, 2,6-(diamino)purine, 5 substituted pyrimidines, N2-substituted purines, N6-substituted purines, 06-substituted purines, substituted 1,2,4-triazoles, pyrrolo-pyrimidin-2-on-3-yl, 6-phenyl-pyrrolo-pyrimidin-2-on-3-yl, para-substituted-6-phenyl-pyrrolo-pyrimidin-2-on-3-yl, ortho-substituted-6-phenyl-pyrrolo-pyrimidin-2-on-3-yl, bis-ortho-substituted-6-phenyl-pyrrolo-pyrimidin-2-on-3-yl, para-(aminoalkylhydroxy)-6-phenyl-pyrrolo-pyrimidin-2-on-3-yl, ortho-(aminoalkylhydroxy)-6-phenyl-pyrrolo-pyrimidin-2-on-3-yl, bis-ortho-(aminoalkylhydroxy)-6-phenyl-pyrrolo-pyrimidin-2-on-3-yl, pyridopyrimidin-3-yl, 2-oxo-7-amino-pyridopyrimidin-3-yl, 2-oxo-pyridopyrimidine-3-yl, or any O-alkylated or N-alkylated derivatives thereof. Modified nucleosides also include natural bases that comprise conjugated moieties, e.g. a ligand. As discussed herein above, the RNA containing the modified nucleosides must be translatable in a host cell (i.e., does not prevent translation of the polypeptide encoded by the modified RNA). For example, transcripts containing s2U and m6A are translated poorly in rabbit reticulocyte lysates, while pseudouridine, m5U, and m5C are compatible with efficient translation. In addition, it is known in the art that 2'-fluoro-modified bases useful for increasing nuclease resistance of a transcript, leads to very inefficient translation. Translation can be assayed by one of ordinary skill in the art using e.g., a rabbit reticulocyte lysate translation assay.

Further modified nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in Int. Appl. No. PCT/US09/038,425, filed Mar. 26, 2009; those disclosed in The Concise Encyclopedia Of Polymer Science And Engineering, pages 858-859, Kroschwitz, J. L, ed. John Wiley & Sons, 1990, and those disclosed by Englisch et al., Angewandte Chemie, International Edition, 1991, 30, 613.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121; 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference in its entirety, and U.S. Pat. No. 5,750,692, also herein incorporated by reference in its entirety.

Another modification for use with the synthetic, modified RNAs described herein involves chemically linking to the RNA one or more ligands, moieties or conjugates that enhance the activity, cellular distribution or cellular uptake of the RNA. The synthetic, modified RNAs described herein can further comprise a 5' cap. In some embodiments of the aspects described herein, the synthetic, modified RNAs comprise a 5' cap comprising a modified guanine nucleotide that is linked to the 5' end of an RNA molecule using a 5'-5' triphosphate linkage. As used herein, the term "5' cap" is also intended to encompass other 5' cap analogs including, e.g., 5' diguanosine cap, tetraphosphate cap analogs having a methylene-bis(phosphonate) moiety (see e.g., Rydzik, A M et al., (2009) Org Biomol Chem 7(22):4763-76), dinucleotide cap analogs having a phosphorothioate modification (see e.g., Kowalska, J. et al., (2008) RNA 14(6):1119-1131), cap analogs having a sulfur substitution for a non-bridging oxygen (see e.g., Grudzien-Nogalska, E. et al., (2007) RNA 13(10): 1745-1755), N7-benzylated dinucleoside tetraphosphate analogs (see e.g., Grudzien, E. et al., (2004) RNA 10(9):1479-1487), or anti-reverse cap analogs (see e.g., Jemielity, J. et al., (2003) RNA 9(9): 1108-1122 and Stepinski, J. et al., (2001) RNA 7(10):1486-1495). In one such embodiment, the 5' cap analog is a 5' diguanosine cap. In some embodiments, the synthetic, modified RNA does not comprise a 5' triphosphate.

The 5' cap is important for recognition and attachment of an mRNA to a ribosome to initiate translation. The κ' cap also protects the synthetic, modified RNA from 5' exonuclease mediated degradation. It is not an absolute requirement that a synthetic, modified RNA comprise a 5' cap, and thus in other embodiments the synthetic, modified RNAs lack a 5' cap. However, due to the longer half-life of synthetic, modified RNAs comprising a 5' cap and the increased efficiency of translation, synthetic, modified RNAs comprising a 5' cap are preferred herein.

The synthetic, modified RNAs described herein can further comprise a 5' and/or 3' untranslated region (UTR). Untranslated regions are regions of the RNA before the start codon (5') and after the stop codon (3'), and are therefore not translated by the translation machinery. Modification of an RNA molecule with one or more untranslated regions can improve the stability of an mRNA, since the untranslated regions can interfere with ribonucleases and other proteins involved in RNA degradation. In addition, modification of an RNA with a 5' and/or 3' untranslated region can enhance translational efficiency by binding proteins that alter ribosome binding to an mRNA. Modification of an RNA with a 3' UTR can be used to maintain a cytoplasmic localization of the RNA, permitting translation to occur in the cytoplasm of the cell. In one embodiment, the synthetic, modified RNAs described herein do not comprise a 5' or 3' UTR. In another embodiment, the synthetic, modified RNAs comprise either a 5' or 3' UTR. In another embodiment, the synthetic, modified RNAs described herein comprise both a 5' and a 3' UTR. In one embodiment, the 5' and/or 3' UTR is selected from an mRNA known to have high stability in the cell (e.g., a murine alpha-globin 3' UTR). In some embodiments, the 5' UTR, the 3' UTR, or both comprise one or more modified nucleosides.

In some embodiments, the synthetic, modified RNAs described herein further comprise a Kozak sequence. The "Kozak sequence" refers to a sequence on eukaryotic mRNA having the consensus (gcc)gccRccAUGG, where R is a purine (adenine or guanine) three bases upstream of the start codon (AUG), which is followed by another 'G'. The Kozak consensus sequence is recognized by the ribosome to initiate translation of a polypeptide. Typically, initiation occurs at the first AUG codon encountered by the translation machinery that is proximal to the 5' end of the transcript. However, in some cases, this AUG codon can be bypassed in a process called leaky scanning. The presence of a Kozak sequence near the AUG codon will strengthen that codon as the initiating site of translation, such that translation of the correct polypeptide occurs. Furthermore, addition of a Kozak sequence to a synthetic, modified RNA will promote more efficient translation, even if there is no ambiguity regarding the start codon. Thus, in some embodiments, the synthetic, modified RNAs described herein further comprise a Kozak consensus sequence at the desired site for initiation of translation to produce the correct length polypeptide. In some such embodiments, the Kozak sequence comprises one or more modified nucleosides.

In some embodiments, the synthetic, modified RNAs described herein further comprise a "poly (A) tail", which refers to a 3' homopolymeric tail of adenine nucleotides, which can vary in length (e.g., at least 5 adenine nucleotides) and can be up to several hundred adenine nucleotides). The inclusion of a 3' poly(A) tail can protect the synthetic, modified RNA from degradation in the cell, and also facilitates extra-nuclear localization to enhance translation efficiency. In some embodiments, the poly(A) tail comprises between 1 and 500 adenine nucleotides; in other embodiments the poly(A) tail comprises at least 5, at least 10, at least 20, at least 30, at least 40, at least 50, at least 60, at least 70, at least 80, at least 90, at least 100, at least 110, at least 120, at least 130, at least 140, at least 150, at least 160, at least 170, at least 180, at least 190, at least 200, at least 225, at least 250, at least 275, at least 300, at least 325, at least 350, at least 375, at least 400, at least 425, at least 450, at least 475, at least 500 adenine nucleotides or more. In one embodiment, the poly(A) tail comprises between 1 and 150 adenine nucleotides. In another embodiment, the poly(A) tail comprises between 90 and 120 adenine nucleotides. In some such embodiments, the poly(A) tail comprises one or more modified nucleosides.

It is contemplated that one or more modifications to the synthetic, modified RNAs described herein permit greater stability of the synthetic, modified RNA in a cell. To the extent that such modifications permit translation and either reduce or do not exacerbate a cell's innate immune or interferon response to the synthetic, modified RNA with the modification, such modifications are specifically contemplated for use herein. Generally, the greater the stability of a synthetic, modified RNA, the more protein can be produced from that synthetic, modified RNA. Typically, the presence of AU-rich regions in mammalian mRNAs tend to destabilize transcripts, as cellular proteins are recruited to AU-rich regions to stimulate removal of the poly(A) tail of the transcript. Loss of a poly(A) tail of a synthetic, modified RNA can result in increased RNA degradation. Thus, in one embodiment, a synthetic, modified RNA as described herein does not comprise an AU-rich region. In particular, it is preferred that the 3' UTR substantially lacks AUUUA sequence elements.

In one embodiment, a ligand alters the cellular uptake, intracellular targeting or half-life of a synthetic, modified RNA into which it is incorporated. In some embodiments a ligand provides an enhanced affinity for a selected target, e.g., molecule, cell or cell type, intracellular compartment, e.g., mitochondria, cytoplasm, peroxisome, lysosome, as, e.g., compared to a composition absent such a ligand. Preferred ligands do not interfere with expression of a polypeptide from the synthetic, modified RNA.

The ligand can be a substance, e.g., a drug, which can increase the uptake of the synthetic, modified RNA or a composition thereof into the cell, for example, by disrupting the cell's cytoskeleton, e.g., by disrupting the cell's microtubules, microfilaments, and/or intermediate filaments. The drug can be, for example, taxol, vincristine, vinblastine, cytochalasin, nocodazole, japlakinolide, latrunculin A, phalloidin, swinholide A, indanocine, or myoservin.

In another aspect, the ligand is a moiety, e.g., a vitamin, which is taken up by a host cell. Exemplary vitamins include vitamin A, E, and K. Other exemplary vitamins include B vitamin, e.g., folic acid, B12, riboflavin, biotin, pyridoxal or other vitamins or nutrients taken up, for example, by cancer cells. Also included are HSA and low density lipoprotein (LDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

The synthetic, modified RNAs described herein can be synthesized and/or modified by methods well established in the art, such as those described in "Current Protocols in Nucleic Acid Chemistry," Beaucage, S. L. et al. (Edrs.), John Wiley & Sons, Inc., New York, N.Y., USA, which is hereby incorporated herein by reference in its entirety. Transcription methods are described further herein in the Examples.

In one embodiment of the aspects described herein, a template for a synthetic, modified RNA is synthesized using "splint-mediated ligation," which allows for the rapid synthesis of DNA constructs by controlled concatenation of long oligos and/or dsDNA PCR products and without the need to introduce restriction sites at the joining regions. It can be used to add generic untranslated regions (UTRs) to the coding sequences of genes during T7 template generation. Splint mediated ligation can also be used to add nuclear localization sequences to an open reading frame, and to make dominant-negative constructs with point mutations starting from a wild-type open reading frame. Briefly, single-stranded and/or denatured dsDNA components are annealed to splint oligos which bring the desired ends into conjunction, the ends are ligated by a thermostable DNA ligase and the desired constructs amplified by PCR. A synthetic, modified RNA is then synthesized from the template using an RNA polymerase in vitro. After synthesis of a synthetic, modified RNA is complete, the DNA template is removed from the transcription reaction prior to use with the methods described herein.

In some embodiments of these aspects, the synthetic, modified RNAs are further treated with an alkaline phosphatase.

One skilled in the art readily appreciates that the present invention is well adapted to carry out the objects and obtain the ends and advantages mentioned, as well as those inherent therein. The details of the description and the examples herein are representative of certain embodiments, are exemplary, and are not intended as limitations on the scope of the invention. Modifications therein and other uses will occur to those skilled in the art. These modifications are encompassed within the spirit of the invention. It will be readily apparent to a person skilled in the art that varying substitutions and modifications may be made to the invention disclosed herein without departing from the scope and spirit of the invention.

The articles "a" and "an" as used herein in the specification and in the claims, unless clearly indicated to the contrary, should be understood to include the plural referents. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process. Furthermore, it is to be understood that the invention provides all variations, combinations, and permutations in which one or more limitations, elements, clauses, descriptive terms, etc., from one or more of the listed claims is introduced into another claim dependent on the same base claim (or, as relevant, any other claim) unless otherwise indicated or unless it would be evident to one of ordinary skill in the art that a contradiction or inconsistency would arise. It is contemplated that all embodiments described herein are applicable to all different aspects of the invention where appropriate. It is also contemplated that any of the embodiments or aspects can be freely combined with one or more other such embodiments or aspects whenever appropriate. Where elements are presented as lists, e.g., in Markush group or similar format, it is to be understood that each subgroup of the elements is also disclosed, and any element(s) can be removed from the group. It should be understood that, in general, where the invention, or aspects of the invention, is/are referred to as comprising particular elements, features, etc., certain embodiments of the invention or aspects of the invention consist, or consist essentially of, such elements, features, etc. For purposes of simplicity those embodiments have not in every case been specifically set forth in so many words herein. It should also be understood that any embodiment or aspect of the invention can be explicitly excluded from the claims, regardless of whether the specific exclusion is recited in the specification. For example, any one or more active agents, additives, ingredients, optional agents, types of organism, disorders, subjects, or combinations thereof, can be excluded.

Where the claims or description relate to a composition of matter, it is to be understood that methods of making or using the composition of matter according to any of the methods disclosed herein, and methods of using the composition of matter for any of the purposes disclosed herein are aspects of the invention, unless otherwise indicated or unless it would be evident to one of ordinary skill in the art that a contradiction or inconsistency would arise. Where the claims or description relate to a method, e.g., it is to be understood that methods of making compositions useful for performing the method, and products produced according to the method, are aspects of the invention, unless otherwise indicated or unless it would be evident to one of ordinary skill in the art that a contradiction or inconsistency would arise.

Where ranges are given herein, the invention includes embodiments in which the endpoints are included, embodiments in which both endpoints are excluded, and embodiments in which one endpoint is included and the other is excluded. It should be assumed that both endpoints are included unless indicated otherwise. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise. It is also understood that where a series of numerical values is stated herein, the invention includes embodiments that relate analogously to any intervening value or range defined by any two values in the series, and that the lowest value may be taken as a minimum and the greatest value may be taken as a maximum. Numerical values, as used herein, include values expressed as percentages. For any embodiment of the invention in which a numerical value is prefaced by "about" or "approximately", the invention includes an embodiment in which the exact value is recited. For any embodiment of the invention in which a numerical value is not prefaced by "about" or "approximately", the invention includes an embodiment in which the value is prefaced by "about" or "approximately".

As used herein "A and/or B", where A and B are different claim terms, generally means at least one of A, B, or both A and B. For example, one sequence which is complementary to and/or hybridizes to another sequence includes (i) one sequence which is complementary to the other sequence even though the one sequence may not necessarily hybridize to the other sequence under all conditions, (ii) one sequence which hybridizes to the other sequence even if the one sequence is not perfectly complementary to the other sequence, and (iii) sequences which are both complementary to and hybridize to the other sequence.

"Approximately" or "about" generally includes numbers that fall within a range of 1% or in some embodiments within a range of 5% of a number or in some embodiments within a range of 10% of a number in either direction (greater than or less than the number) unless otherwise stated or otherwise evident from the context (except where such number would impermissibly exceed 100% of a possible value). It should be understood that, unless clearly indicated to the contrary, in any methods claimed herein that include more than one act, the order of the acts of the method is not necessarily limited to the order in which the acts of the method are recited, but the invention includes embodiments in which the order is so limited. It should also be understood that unless otherwise indicated or evident from the context, any product or composition described herein may be considered "isolated".

As used herein the term "comprising" or "comprises" is used in reference to compositions, methods, and respective component(s) thereof, that are essential to the invention, yet open to the inclusion of unspecified elements, whether essential or not.

As used herein the term "consisting essentially of" refers to those elements required for a given embodiment. The term permits the presence of additional elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

EXAMPLES

Example 1: Efficient Ablation of Genes in Human Hematopoietic Stem and Effector Cells Using CRISPR/Cas9

The hematopoietic system is at the forefront of cell-based gene therapies due to the fact that the cells can be readily obtained, manipulated, and reintroduced into patients. The development of genome editing methodologies such as zinc finger nucleases (ZFNs) and transcription activator-like effector nucleases (TALENs) (Urnov et al., 2010); (Joung and Sander, 2013; Scharenberg et al., 2013) have enabled site-specific gene repair or ablation and raised the possibility of treating a broad range of diseases at the genetic level (Pan et al., 2013). Despite much promise, limitations associated with these technologies, including low targeting efficacy and de novo engineering of proteins for each target have precluded wide-spread adoption of these technologies for therapeutic use (Silva et al., 2011). The recent emergence of the clustered, regularly interspaced, palindromic repeats (CRISPR) system for gene editing has the potential to overcome these limitations (Jinek et al., 2012). The CRISPR technology utilizes a fixed nuclease, often the CRISPR-associated protein 9 (Cas9) from *Streptococcus pyogenes*, in combination with a short guide RNA (gRNA) to target the nuclease to a specific DNA sequence (Cong et al., 2013; Jinek et al., 2012; Jinek et al., 2013; Mali et al., 2013). CRISPR/Cas9 relies on simple base-pairing rules between the target DNA and the engineered gRNA rather than protein-DNA interactions required by ZFNs and TALENs (Gaj et al., 2013; Wei et al., 2013). As a result, the CRISPR/Cas9 system has proven extremely simple and flexible. Perhaps most important, this system has achieved highly efficacious alteration of the genome in a number of cell types and organisms (Ding et al., 2013; Hwang et al., 2013; Niu et al., 2014; Wang et al., 2013; Wei et al., 2013).

Given the importance of the hematopoietic system in cell-based gene therapies, we tested the CRISPR/Cas9 system in primary human CD4+ T cells and CD34+ hematopoietic stem and progenitor cells (HSPCs) targeting two clinically relevant genes, beta-2 microglobulin (B2M) and chemokine receptor 5 (CCR5). B2M encodes the accessory chain of major histocompatibility complex (MHC) class I molecules and is required for their surface expression (Bjorkman et al., 1987; Zijlstra et al., 1990). Deletion of B2M is a well-established strategy to ablate MHC class I surface expression (Riolobos et al., 2013), and could be used to generate hypoimmunogenic cells for transplantation and adoptive immunotherapy. CCR5 is the main co-receptor used by CCR5-tropic strains of HIV-1 (Trkola et al., 1996) and a validated target for gene ablation, as mutations resulting in loss of protein expression or haploinsufficiency protect against HIV infection (Catano et al., 2011; Hutter et al., 2009; Martinson et al., 1997; Samson et al., 1996). Moreover, transplantation of CCR5 homozygous mutant HSPCs provides long-term protection against HIV rebound even after discontinuation of antiretroviral therapy (Allers et al., 2011; Hutter et al., 2009). Several attempts have been made to target CCR5 in T cells (Perez et al., 2008; Tebas et al., 2014) and HSPCs (Holt et al., 2010; Schleifman et al., 2011) though the efficiency of gene targeting was not sufficient to protect against viral recrudescence (Tebas et al., 2014). Recently, CCR5 has been targeted using CRISPR/Cas9 in cell lines (Cho et al., 2013) and iPS cells (Ye et al., 2014). However, CRISPR/Cas9 gene editing in primary human hematopoietic cells remains untested. Here we report that use of CRISPR/Cas9 with single gRNAs led to highly efficient CCR5 ablation in CD34+ HSPCs but not B2M in CD4+ T cells. Employing a dual gRNA approach improved gene deletion efficacy in both cell types with biallelic inactivation frequencies reaching 34% for B2M in CD4+ T cells, and 42% for CCR5 in CD34+ HSPCs. Importantly, CRISPR/Cas9 CCR5-edited CD34+ HSPCs retained multi-lineage potential in vitro and in vivo upon xenotransplantation. Deep target capture sequencing of predicted on- and off-target sites in CD34+ HSPCs revealed highly efficacious on-target mutagenesis, and exceedingly low off-target mutagenesis.

Figure 5B:
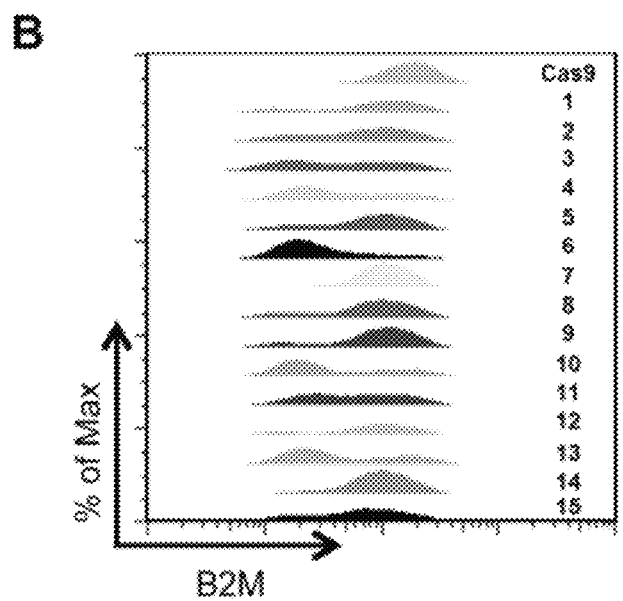
Figure 5C:
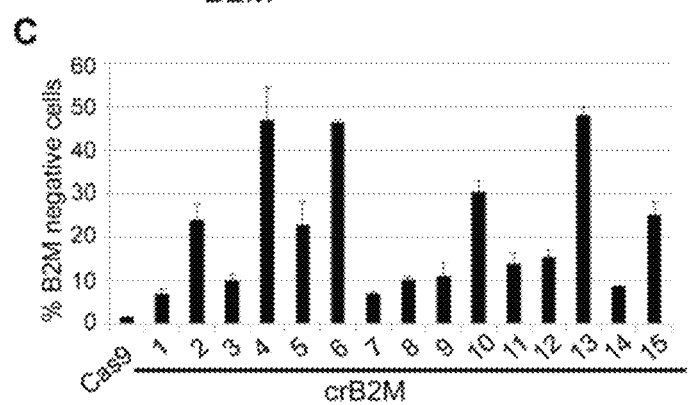
Figure 5D:
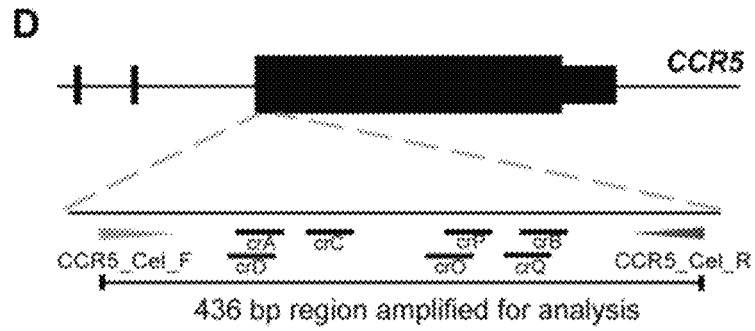
Figures 6A, 6B, 6C, 6D, 6E:
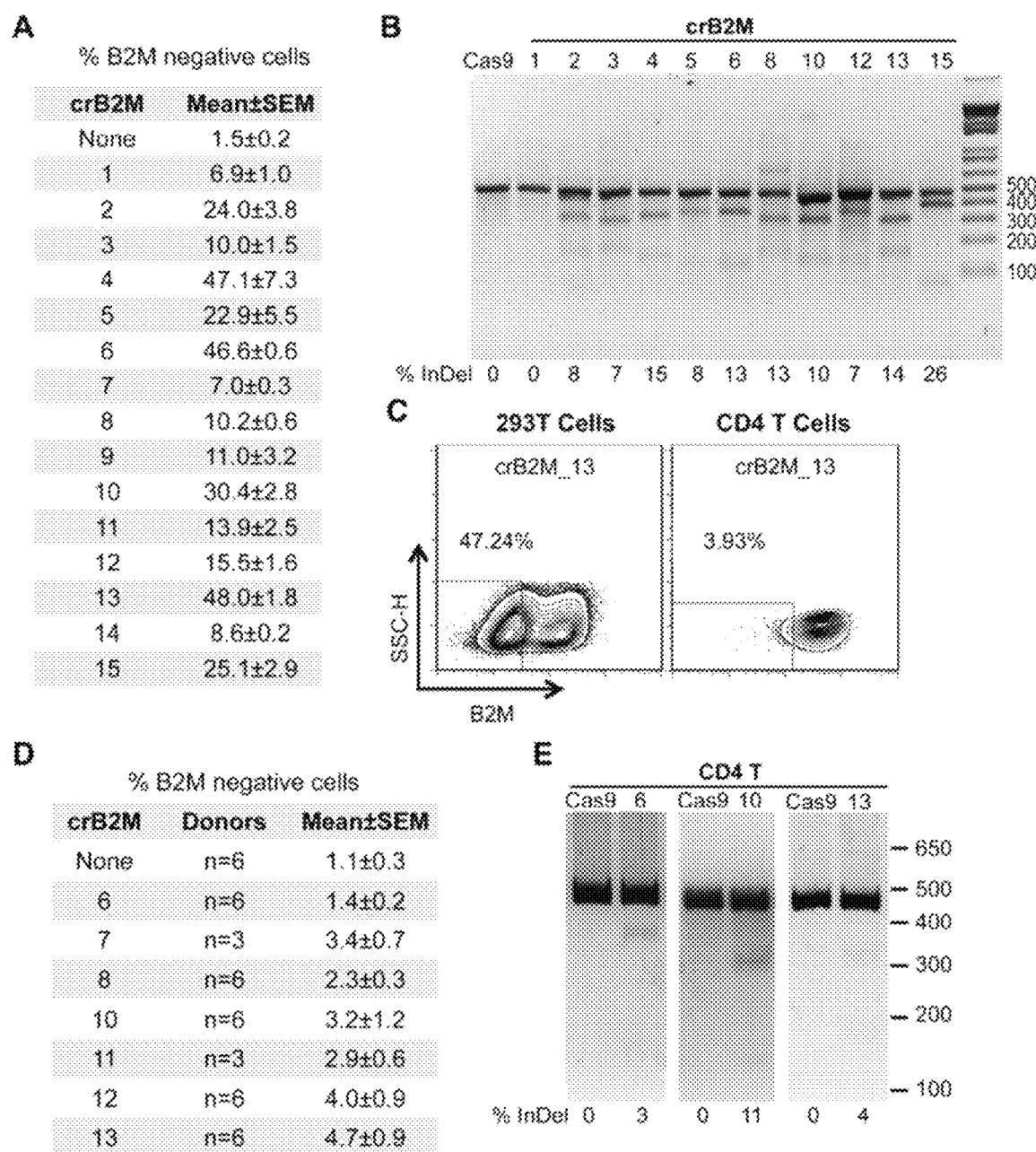
FIGS. 6A, 6B, 6C, 6D and 6E demonstrate an evaluation of on target mutational efficiencies of various gRNAs targeting B2M.

The inventors designed gRNAs to target Cas9 to the B2M gene (FIG. 5A). Each guide was first tested for the ability to direct site-specific mutations in HEK293T cells. Using flow cytometry we measured the efficiency of each gRNA to direct Cas9-mediated ablation of B2M surface expression 72 hours post-transfection (FIG. 5B). We observed that B2M was abrogated in ~7% (±1.02 SEM, n=3) to 48% (±1.80 SEM, n=3) of HEK293T cells depending upon the gRNA utilized (FIG. 5C and FIG. 6A). Similar results were observed using the Surveyor assay, with gRNA-specific mutation frequencies of 0-26% in HEK293T cells (FIG. 6B). The inventors also designed gRNAs to target Cas9 to the CCR5 gene (FIG. 5D). Upon introducing these into K562 cells, we measured targeting efficacy using the Surveyor assay and observed mutation frequencies ranging from 22-40% (FIG. 5E). Variation in the efficiency with which a specific gRNA directed Cas9-mediated ablation was observed, even between gRNAs targeting the same exon or nearly overlapping sites (FIG. 5A-E) indicating that on-target efficiency of site directed mutation is highly gRNA dependent as previously noted (Hsu et al., 2013).

Next, we tested selected single gRNAs in CD4$^+$ T cells and CD34$^+$ HSPCs. Surprisingly, gRNAs that were highly efficacious at targeting B2M in HEK293T cells exhibited lower targeting efficiencies in primary CD4+ T cells ranging from 1.4% (±0.2 SEM, n=6) to 4.7% (±0.9 SEM, n=6) ablation of B2M expression (FIG. 5F and FIGS. 6C-D) or 3-11% using the Surveyor assay (FIGS. 6B and 6E). For instance, crB2M_13 exhibited more than 10-fold reduced efficacy in CD4+ T cells (4.7%±0.9) as compared to HEK293T cells (48.0%±1.8) (FIGS. 5F and 6C). Interestingly, single gRNAs targeting CCR5 showed comparably mutation frequencies in CD34+ HSPCs as observed in K562 cells (FIGS. 5E and 5G). To explore this further we performed direct Sanger sequencing of several hundred colonies derived from HSPC clones targeted with crCCR5_A or crCCR5_B from two donors and observed very high mutation frequencies in all cases (FIG. 5H). As only cells expressing Cas9 were analyzed, it is unlikely that differences in on-target mutation efficiency were due to differential transfection efficiencies, although we cannot rule out differential transfection of individual guides, but rather may reflect intrinsic properties of certain primary hematopoietic cell types.

Figures 7A, 7B, 7C:
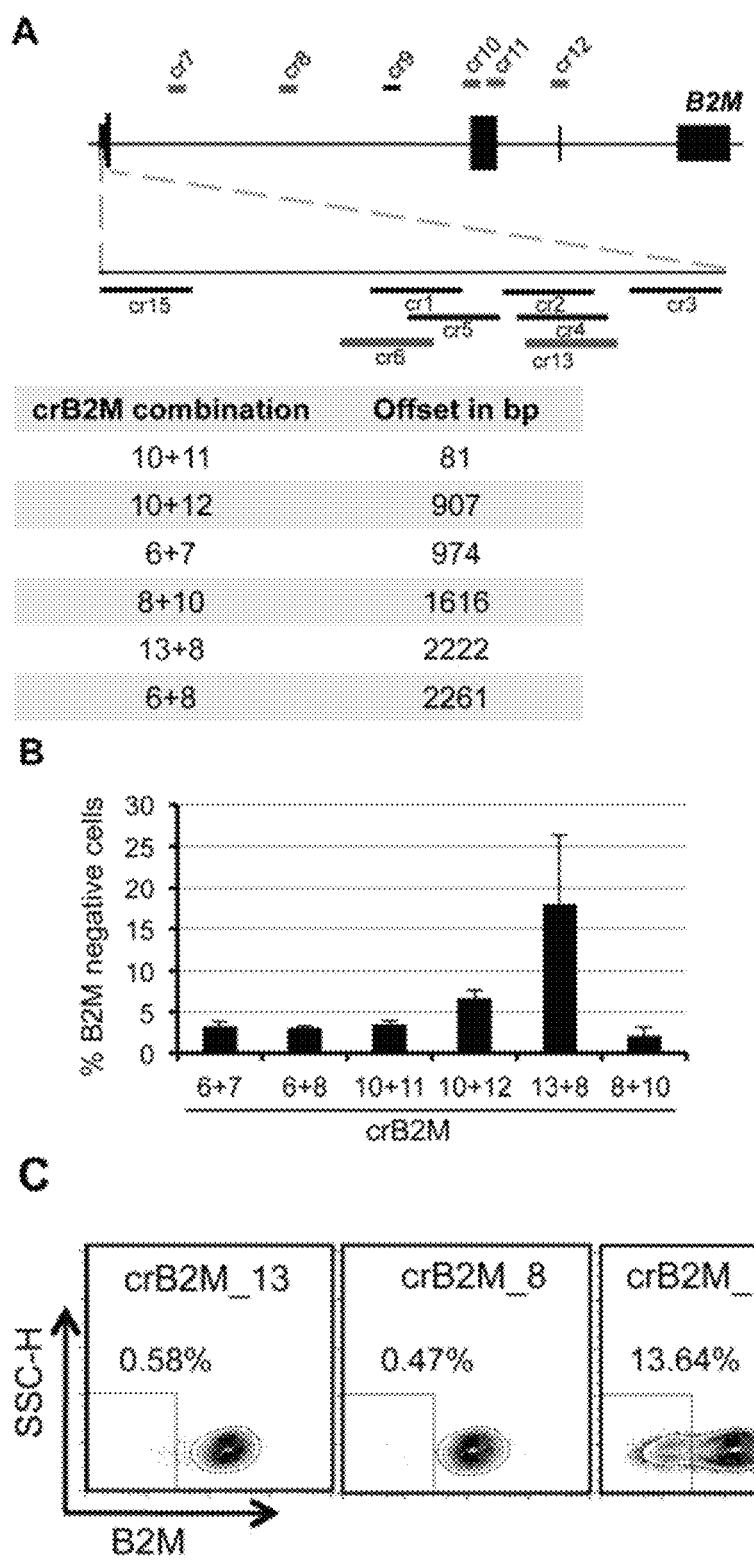
FIGS. 7A, 7B, 7C, 7D and 7E depict a dual gRNA approach for CRISPR/Cas9 genome editing in primary human hematopoietic stem and effector cells.
Figures 8D, 8E, 8F, 8G:
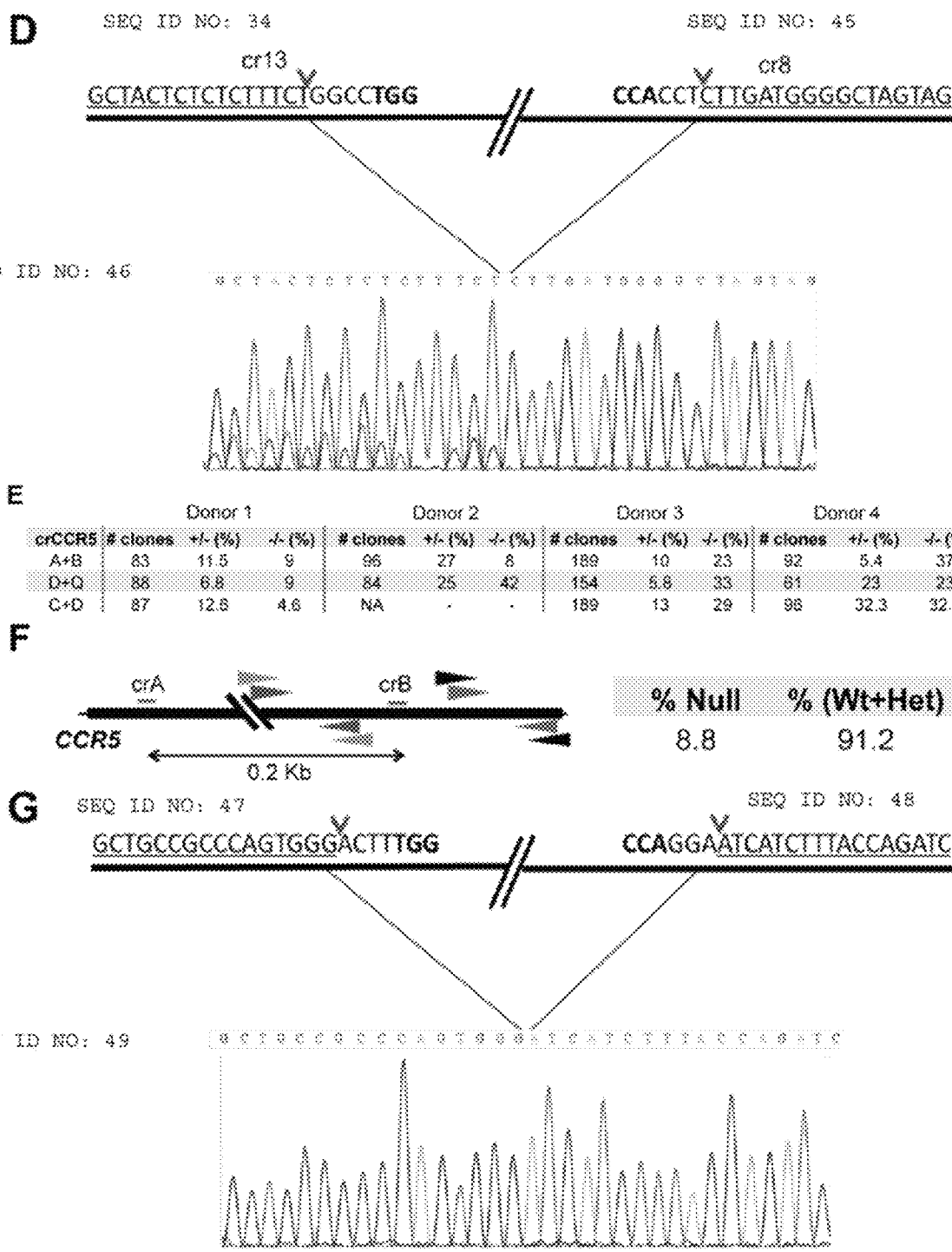

The inventors reasoned that using two gRNAs directed against the same locus might generate predictable mutations (deletions) more frequently than that achieved by error-prone non-homologous end joining (NHEJ), which represents the predominant DNA double strand break (DSB) repair pathway in HSPCs (Beerman et al., 2014). Indeed, this approach has previously been utilized for ZFNs, TALENs and the CRISPR/Cas9 system to achieve predictable deletions (Bauer et al., 2013; Canver et al., 2014; Gupta et al., 2013; Lee et al., 2010; Wang et al., 2014; Zhou et al., 2014). Six dual gRNA combinations targeting B2M with DNA sequence lengths between their predicted Cas9 cleavage sites ranging from 81 to 2261 nucleotides were introduced in CD4+ T cells together with Cas9 (FIG. 7A). We observed a trend of improved targeting efficacy for most of the tested gRNA pairs and greatly improved efficacy for one gRNA pair (crB2M_13+8), which resulted in 18.0% (±8.35 SEM, n=3) ablation of B2M surface expression (FIGS. 7B, 7C and 8A). B2M ablation led to a concomitant reduction of MHC class I cell surface expression (FIG. 8B). The inventors further interrogated mutation frequency at a clonal level via single-cell quantitative PCR (qPCR), which revealed 28.2% (n=301 cells analyzed) of CD4+ T cells were homozygous null for B2M (FIG. 8C). Upon Sanger sequencing across the predicted Cas9 cutting sites we observed deletion of the intervening sequence (FIG. 8D).

Figure 7D:
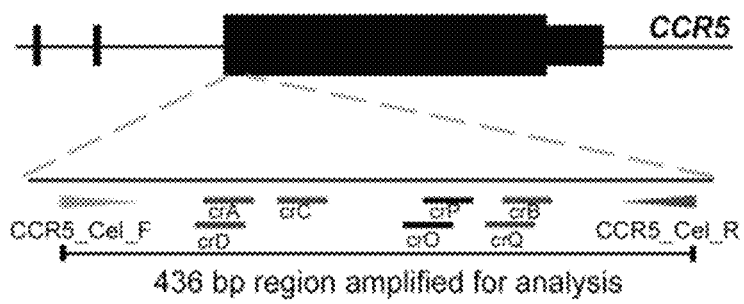
Figure 7E:
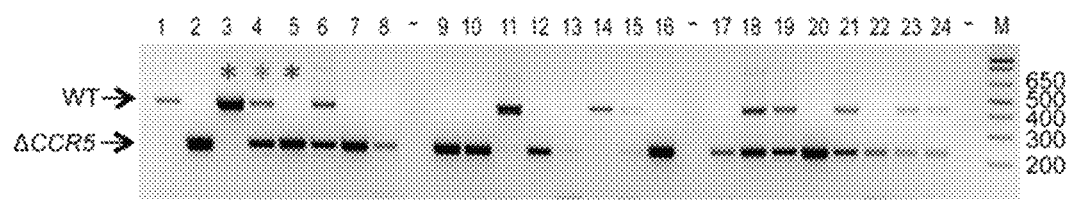

The inventors next applied the dual guide strategy to primary CD34+ HSPCs by introducing three gRNA pairs along with Cas9 (FIG. 7D). Sorted CD34+ HSPCs expressing Cas9 were plated into methylcellulose and emergent clonal colonies were picked two weeks post-plating for analysis. Individual colonies were analyzed by PCR to quantify the deletion efficacy of CCR5 (FIGS. 7D and 7E). Remarkably, although variation in CCR5 ablation was noted among different donors and gRNA pairs, we consistently observed high monoallelic and biallelic inactivation of CCR5 in all cases (FIGS. 7E and 8E). For example, one dual gRNA combination (crCCR5_D+Q) generated biallelic CCR5 deletion in CD34+ HSPCs at a rate of 26.8% (±7.1 SEM) across 4 donors (FIGS. 7E and 8E). It should be noted however that the mutation rates determined by this PCR strategy underestimate actual mutation frequency since small insertions or deletions (InDels) are not detected by this approach. A similar dual gRNA approach targeting CCR5 (crCCR5_A+B) in CD4+ T cells resulted in a biallelic inactivation rate of 8.8% at the single cell level (n=363 cells analyzed) (FIG. 8F). Again, after Sanger sequencing we noted excision of the DNA between the Cas9 cleavage sites (FIG. 8G). Taken together, these data demonstrate that highly efficacious ablation of clinically relevant genes can be achieved in primary hematopoietic CD4+ T cells and CD34+ HSPCs using a dual gRNA strategy.

In order to determine whether CD34+ HSPCs that had undergone genome editing with CRISPR/Cas9 retained their potential to differentiate into effector cells, we performed in vitro and in vivo differentiation assays. Towards this CCR5-edited CD34+ HSPCs were plated in methylcellulose and clonal colonies that emerged two weeks post-plating were counted and scored for contribution to granulocyte, macrophage, erythrocyte and megakaryocyte lineages. Comparable colony numbers and colony types were observed regardless of whether single, dual or no gRNAs were used demonstrating that CD34+ HSPC colony forming potential was not impacted by CRISPR/Cas9 (FIG. 10A) despite the high CCR5 mutation frequencies observed in these experiments (FIGS. 5H and 7E).

Figures 10C, 10D:
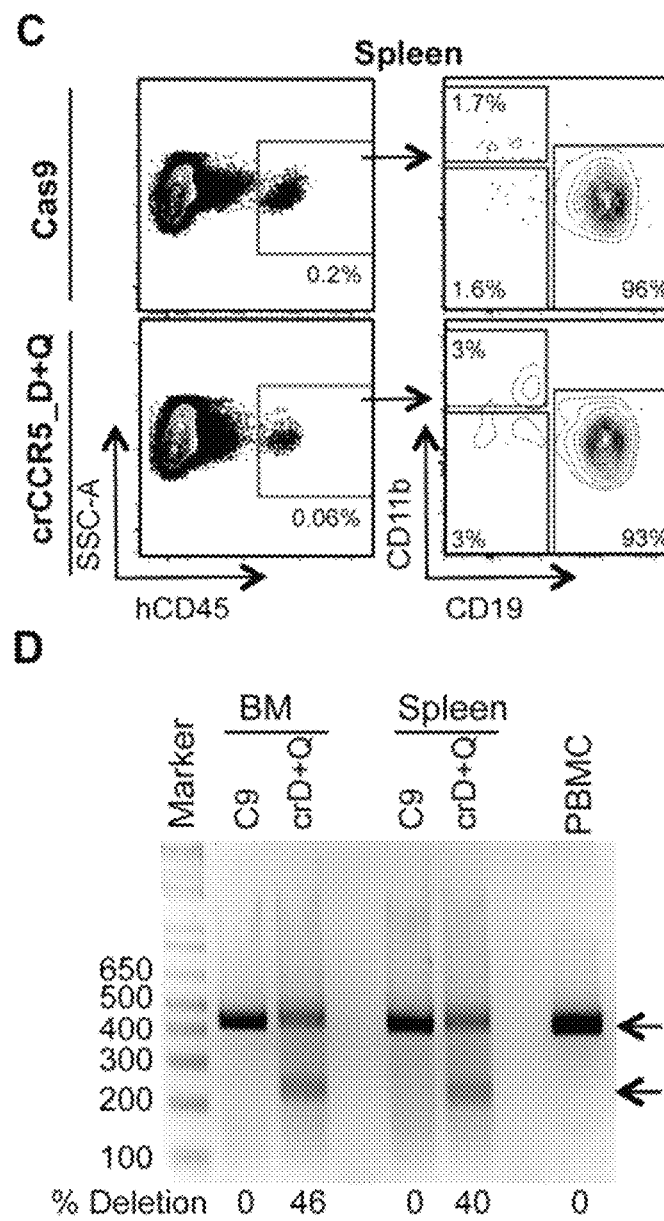

The inventors next tested the in vivo reconstitution potential of HSPCs following CRISPR/Cas9 targeting of CCR5 by xenotransplantation of control (Cas9-only), and CCR5-edited (Cas9+crCCR5 D+Q) CD34+ HSPCs into NOD-Prkdc$^{Scid}$-IL2rγ$^{null}$ (NSG) recipients. Recipients were sacrificed at 12 weeks post-transplantation and human hematopoietic cell engraftment (hCD45+) was examined in the bone marrow revealing CD19+ lymphoid cells and CD11b+ myeloid cells (FIG. 10B). Human CD45+ hematopoietic cells were also found in the peripheral blood (data not shown) and in the spleens of transplanted mice (FIG. 10C). PCR analysis on DNA isolated from sorted human CD45+ hematopoietic cells from reconstituted mice demonstrated that CCR5 edited cells (* CCR5) robustly contributed to human hematopoietic cell chimerism (FIG. 10D). Taken together these results demonstrate that CRISPR/Cas9 CCR5-edited CD34+ HSPCs retained multi-lineage potential in vitro and in vivo.

Figures 11A, 11B, 11C, 11D:
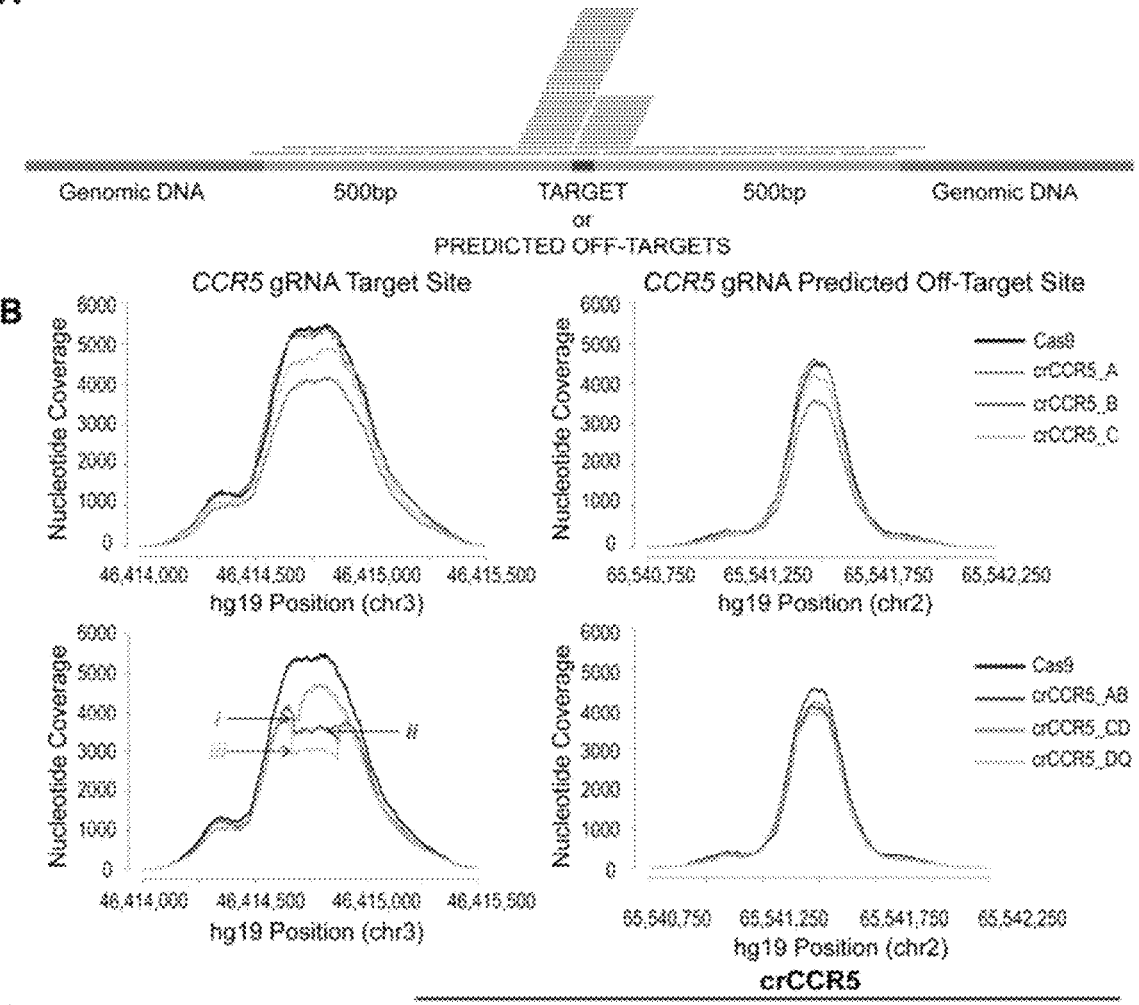
FIGS. 11A, 11B, 11C and 11D demonstrate targeted capture and extremely deep sequencing of on-target and predicted off-target sites in CD34+ HSPCs.
Figure 13:
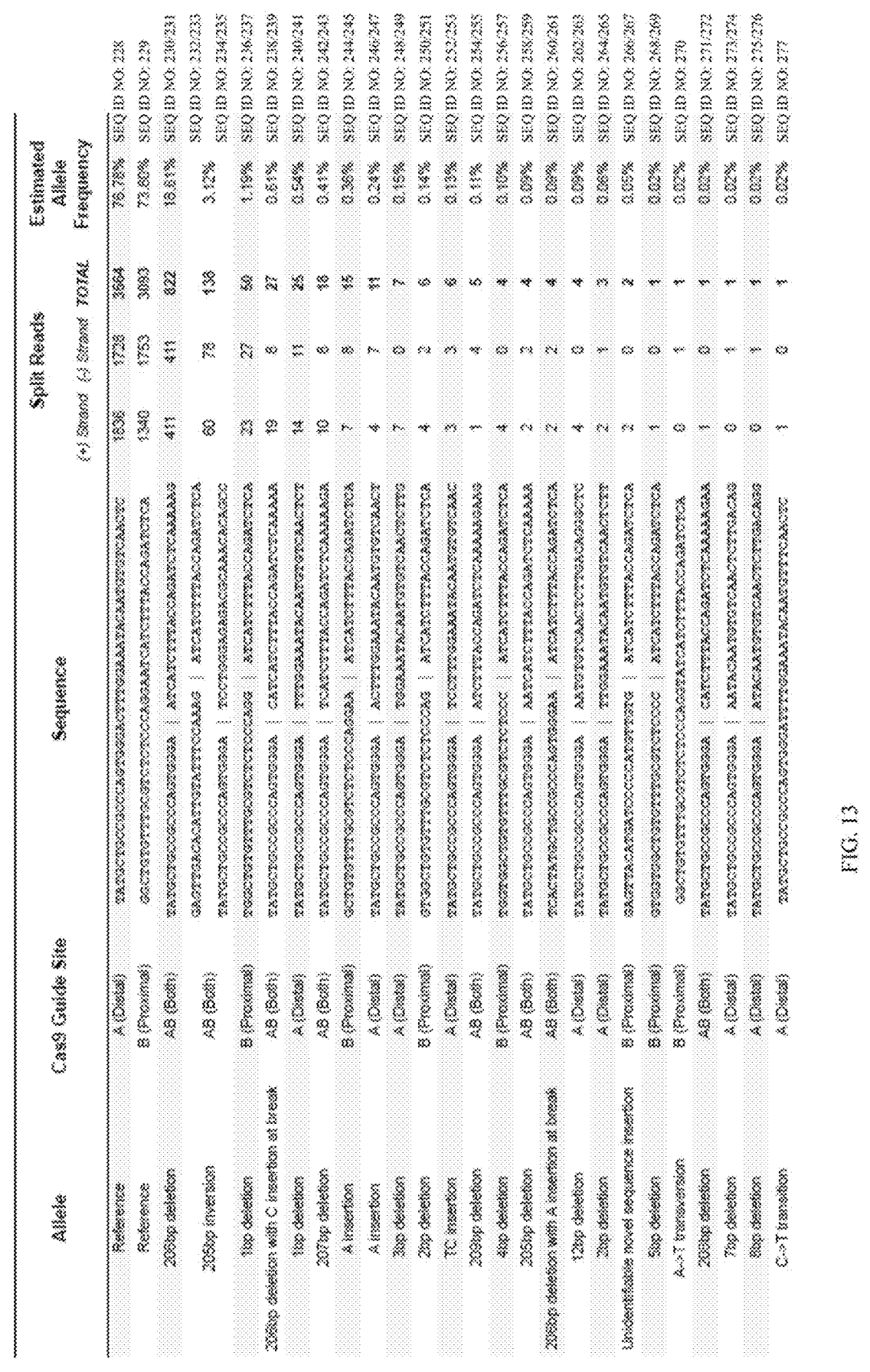
Figure 14:
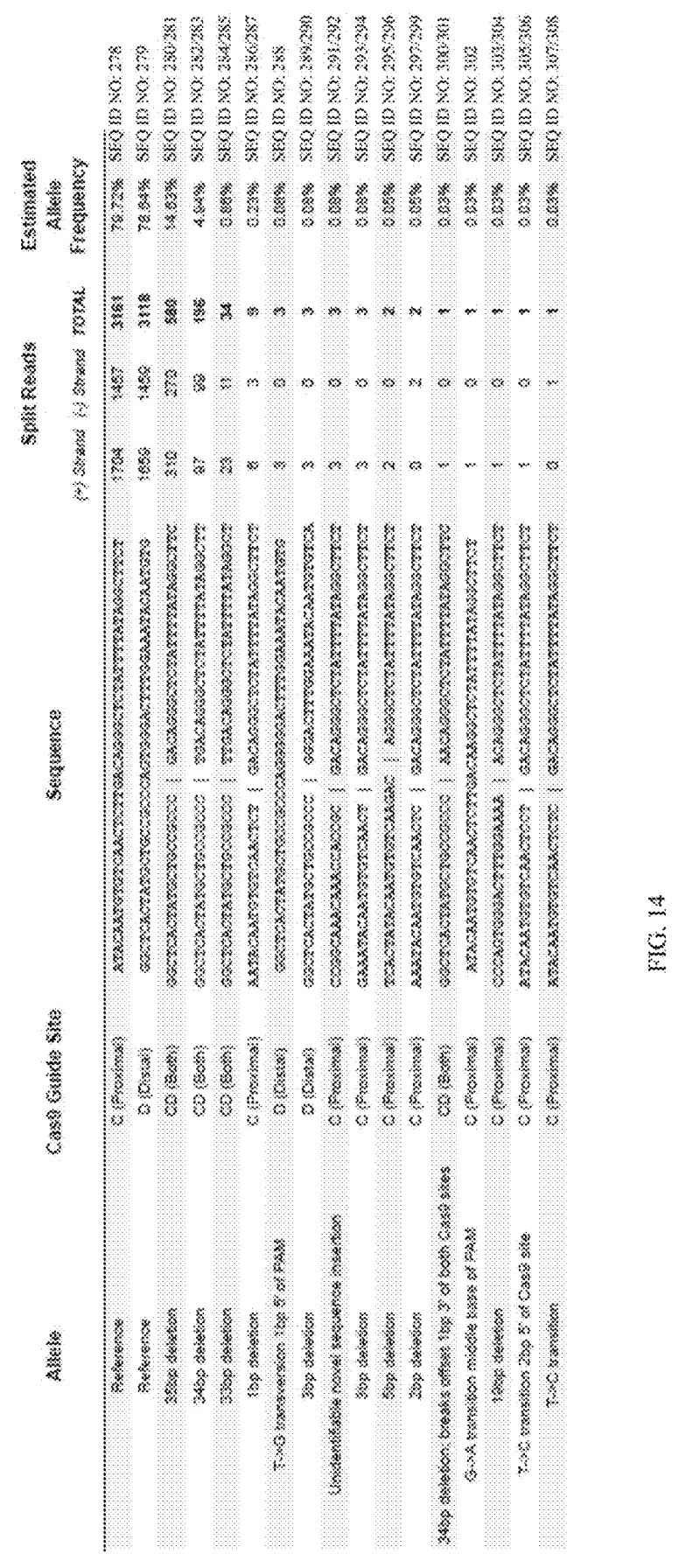
Figure 15:
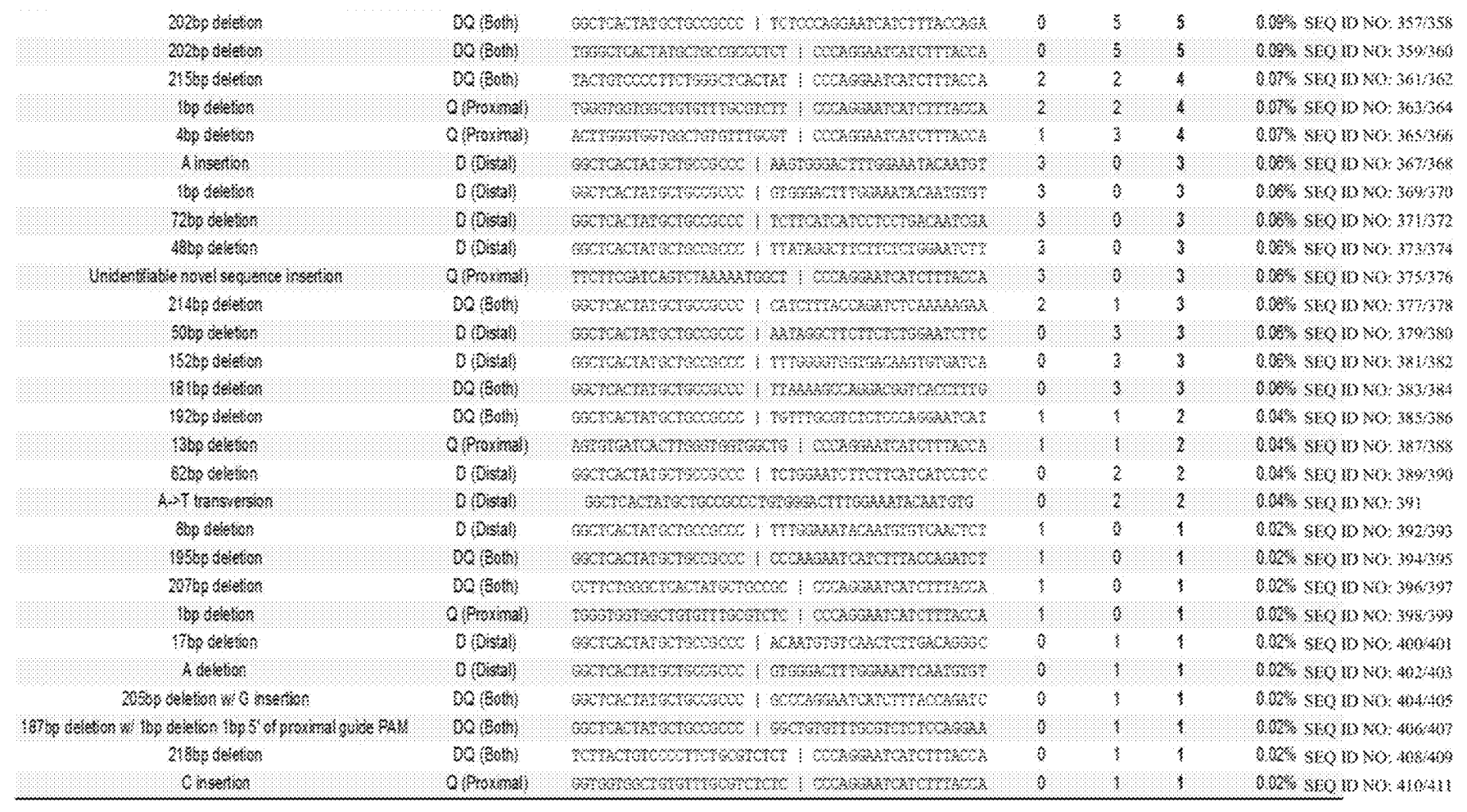
Figure 18:
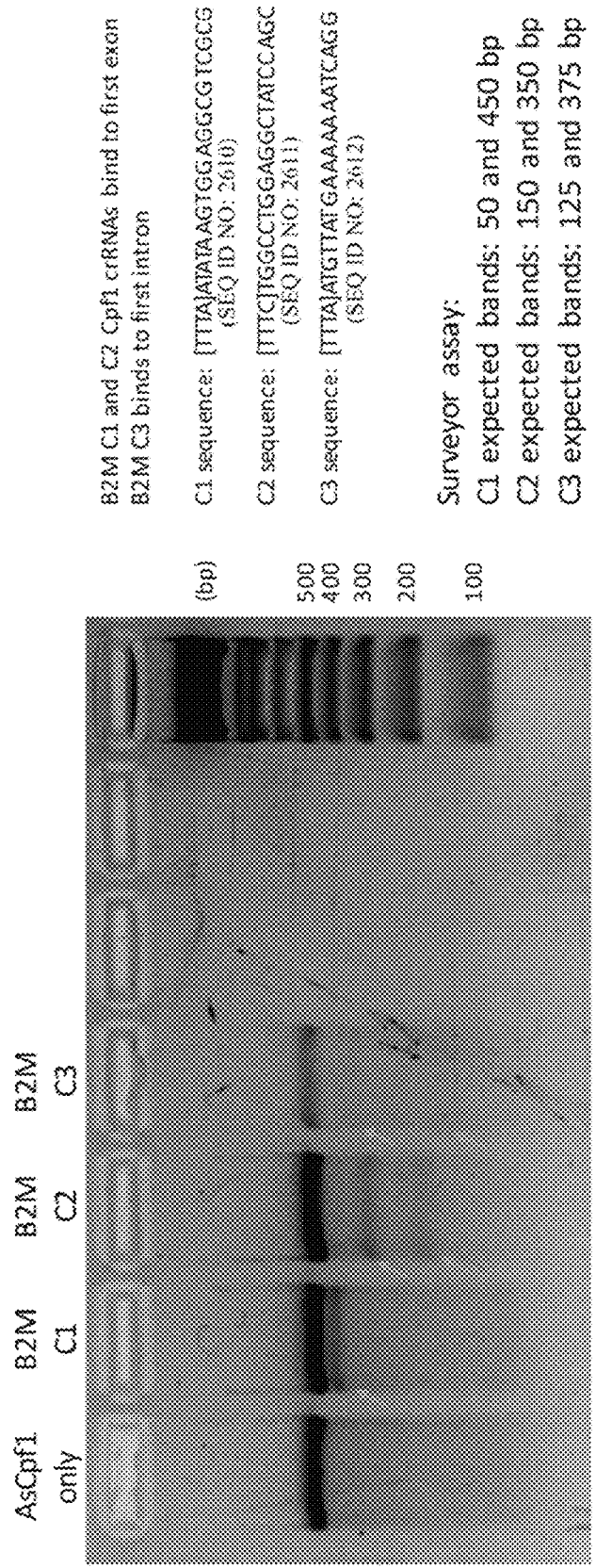
FIG. 18 demonstrates B2M deletion efficiencies of selected guides in 293T cells. Arrows on the Surveyor assays show nuclease cleavage bonds.
Figure 19:
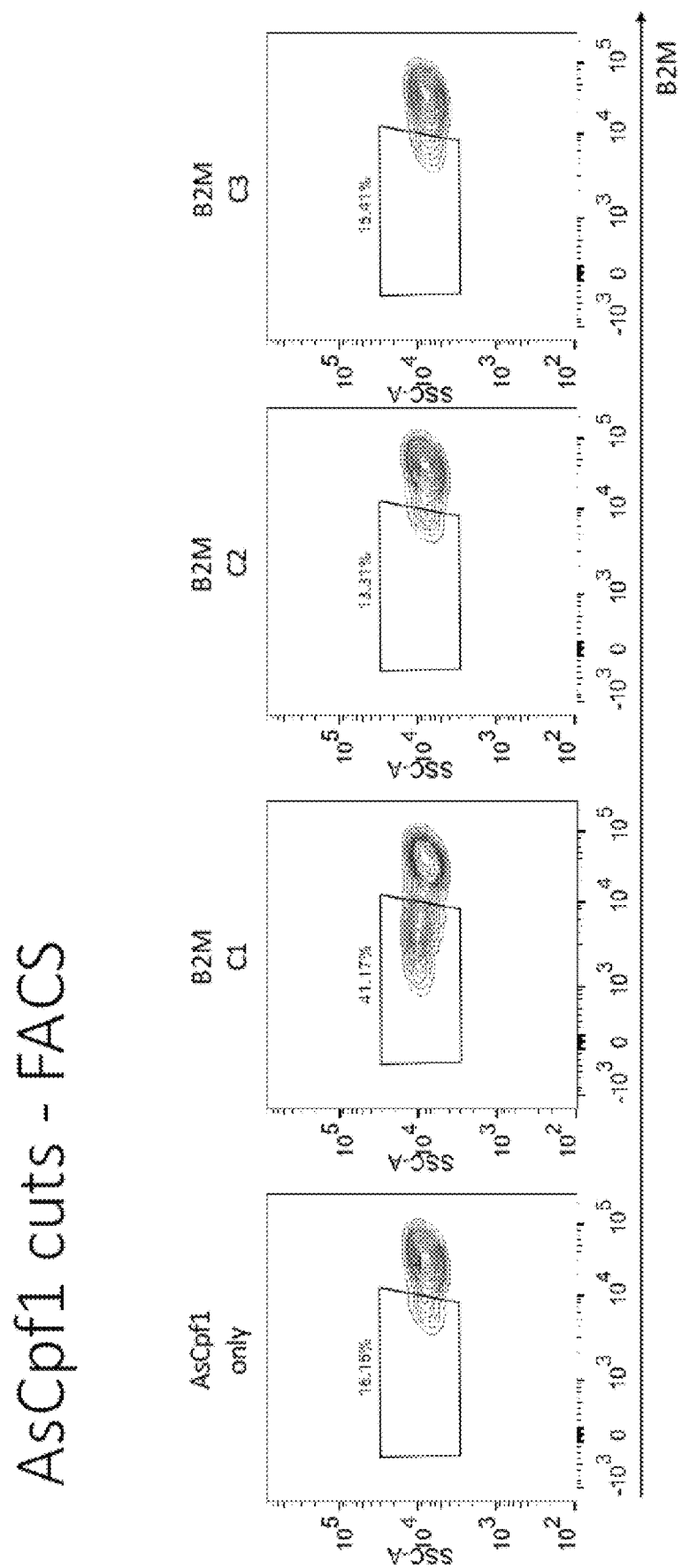
FIG. 19 demonstrates a comparison of B2M surface expression in 293T cells when transfected with AsCpf1 and guide crB2M.
Figure 20:
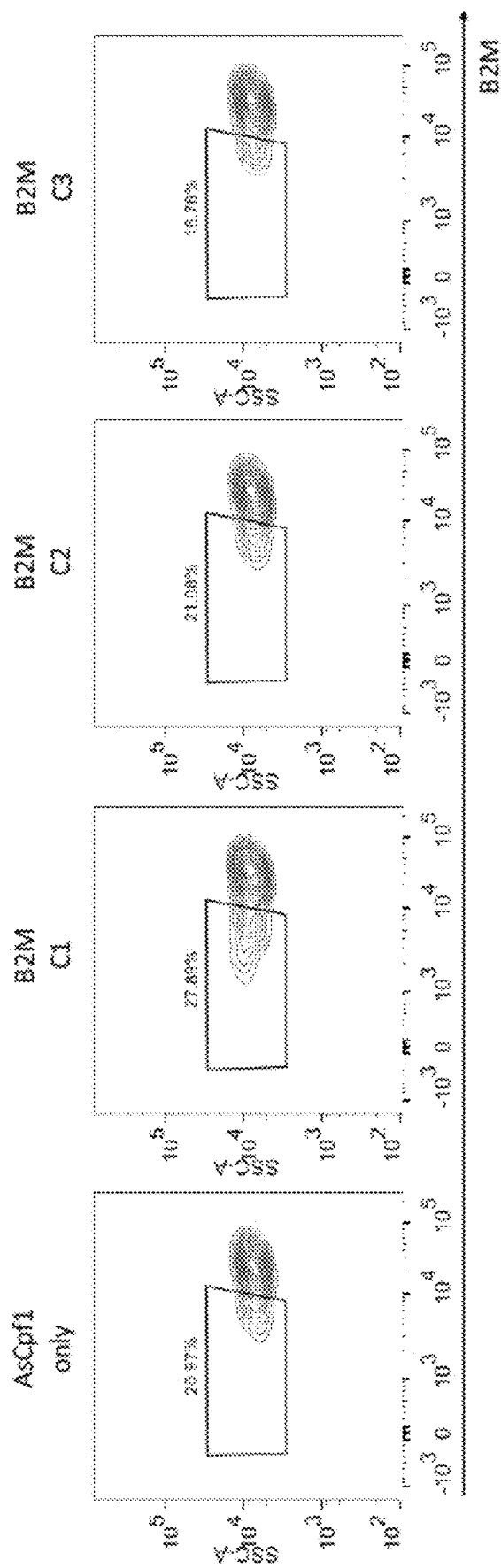
FIG. 20 demonstrates a comparison of B2M surface expression in 293T cells when transfected with LbCpf1 and guide crB2M.
Figure 21:
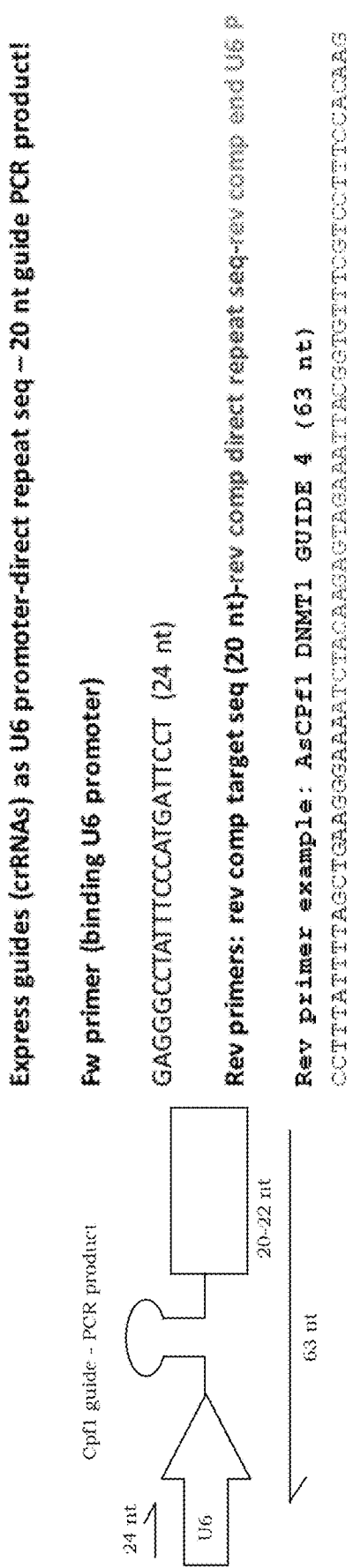
FIG. 21 depicts Cpf1 crRNA design and cloning information.
Figure 22A:
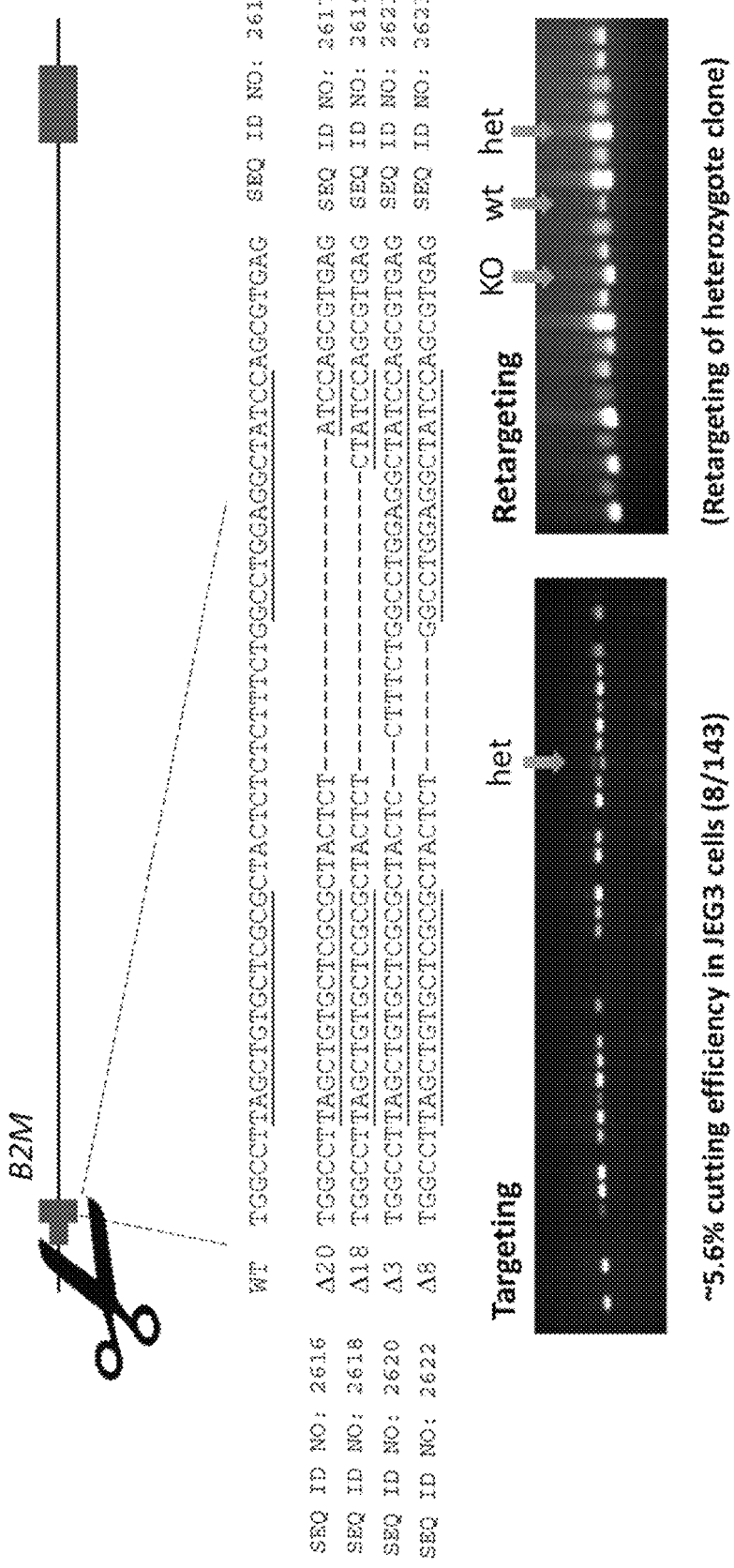
FIGS. 22A, B, C, D, E, F, and G demonstrate generation and characterization of B2M KO JEG3 cells using TALENs.
Figure 22B:
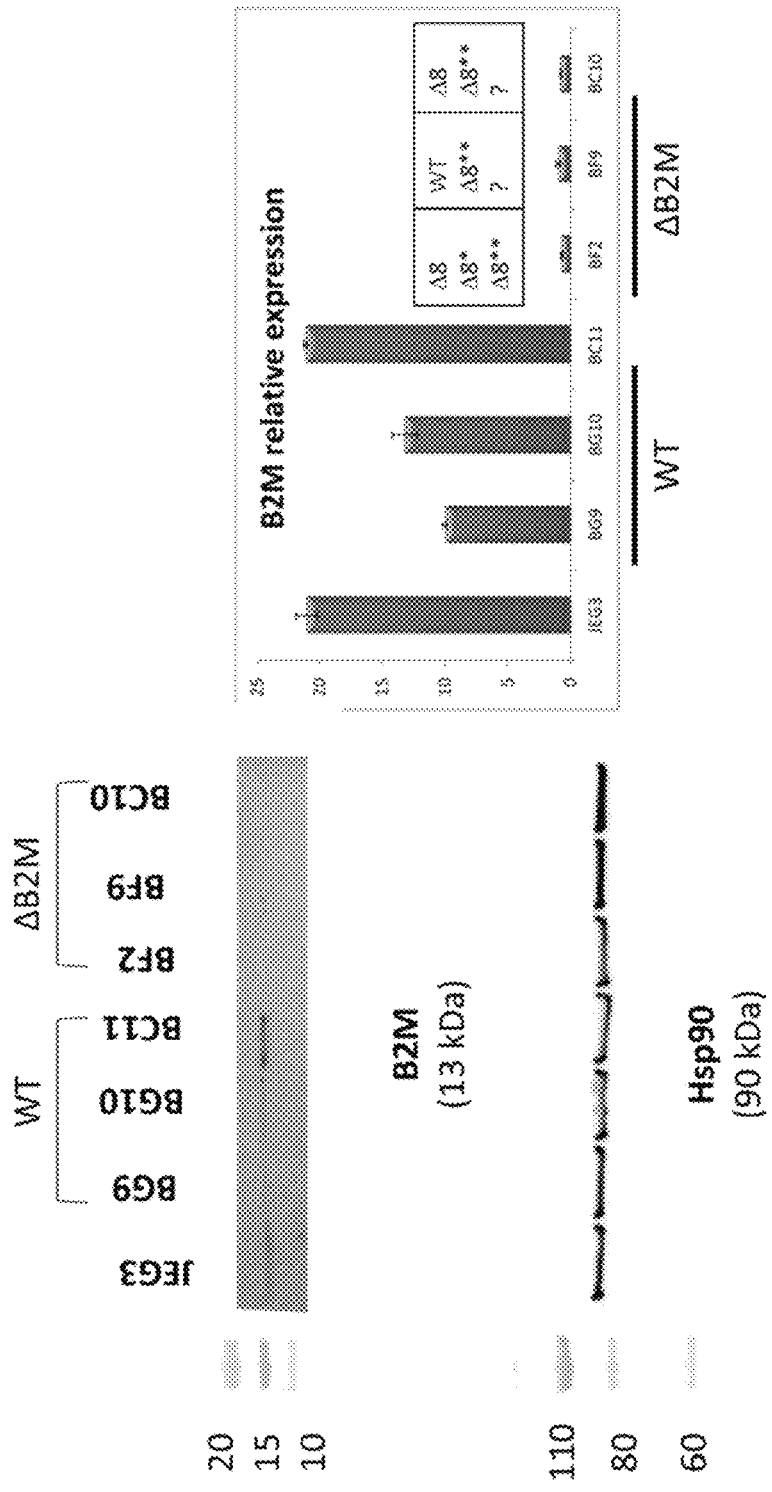
FIG. 22B depicts an analysis of B2M at the transcript and protein levels.
Figure 22C:
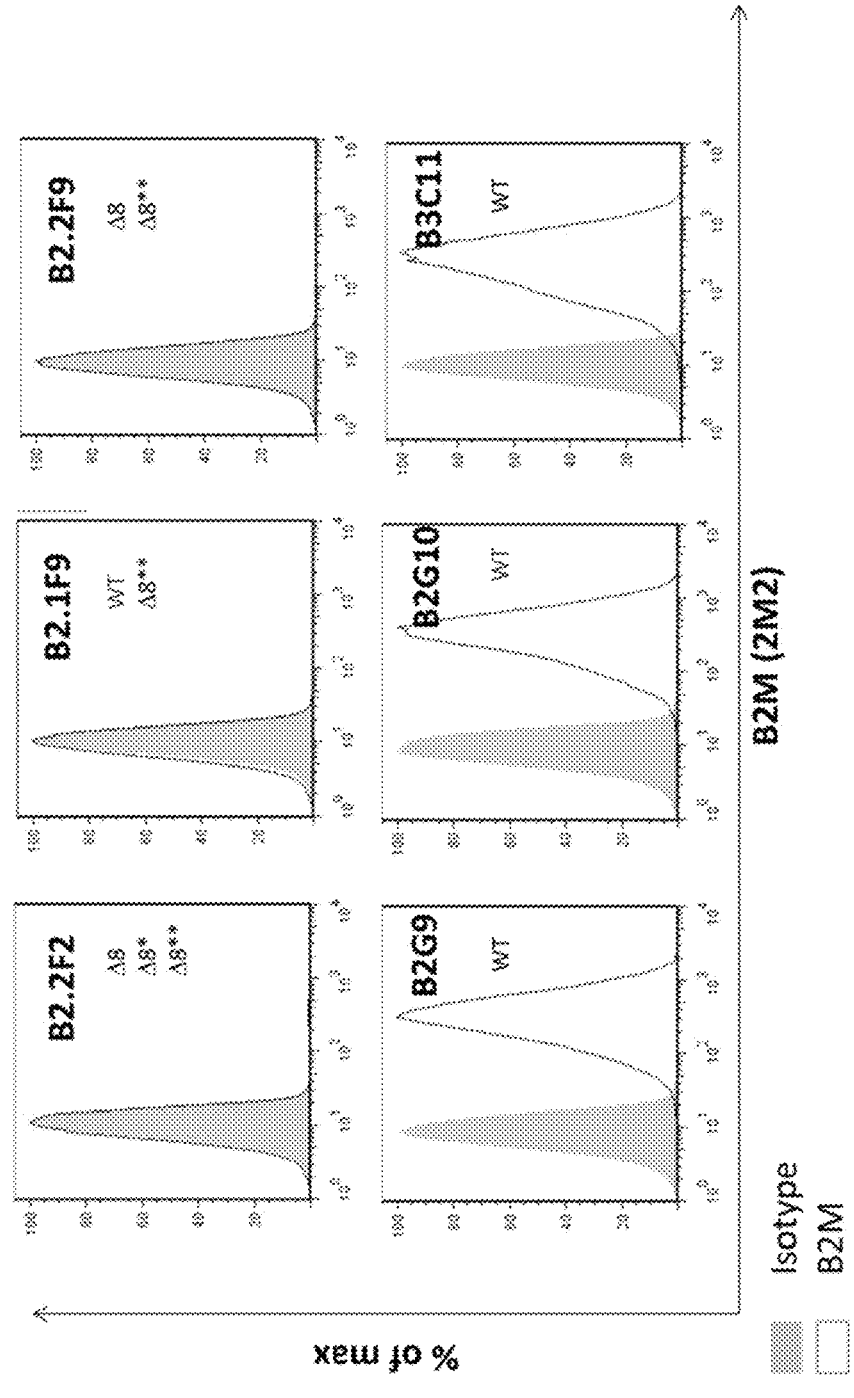
FIG. 22C demonstrates an analysis of B2M at the surface expression level.
Figure 22D:
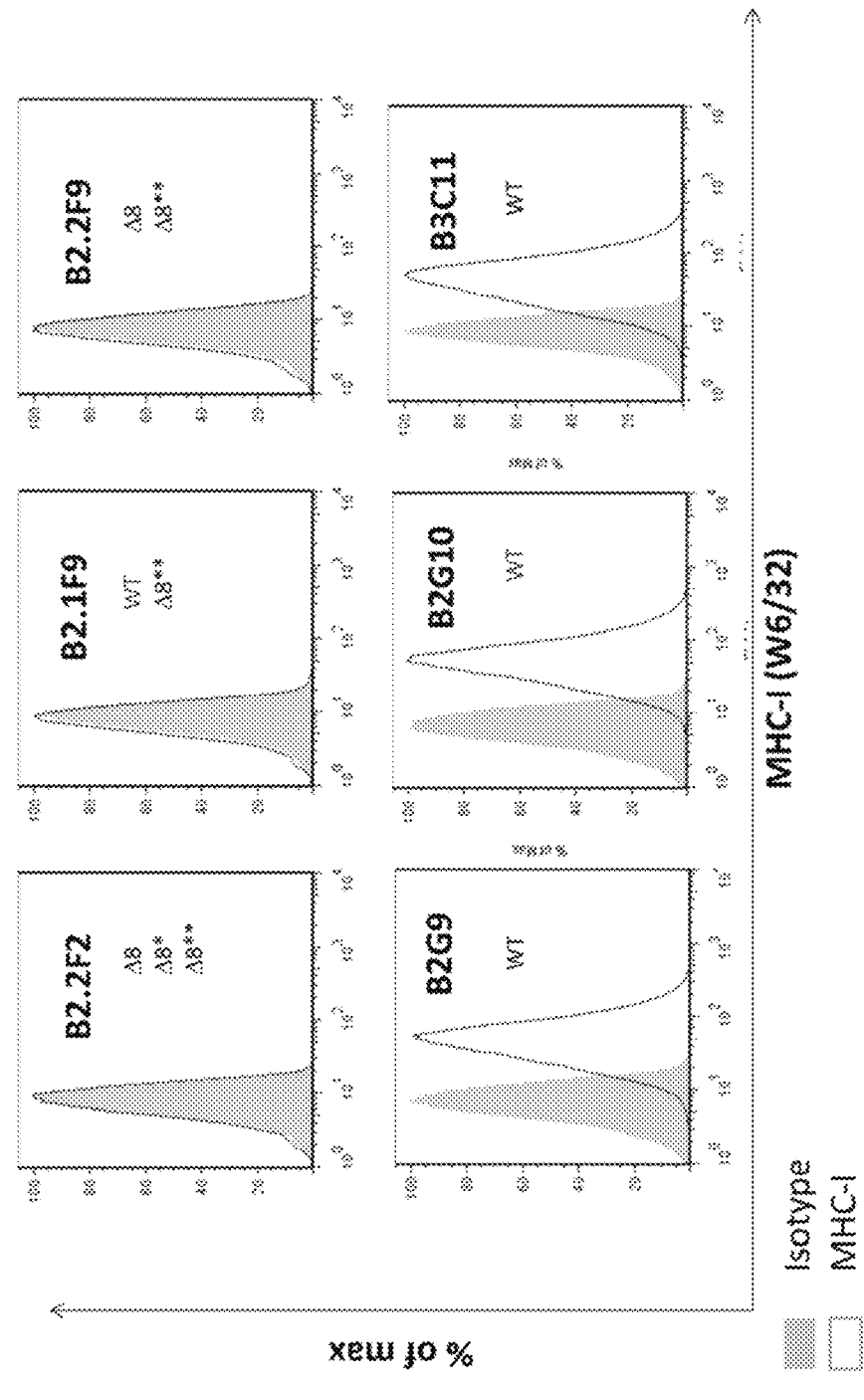
FIG. 22D demonstrates that ΔB2M clones are devoid of MHC-I surface expression.
Figure 22E:
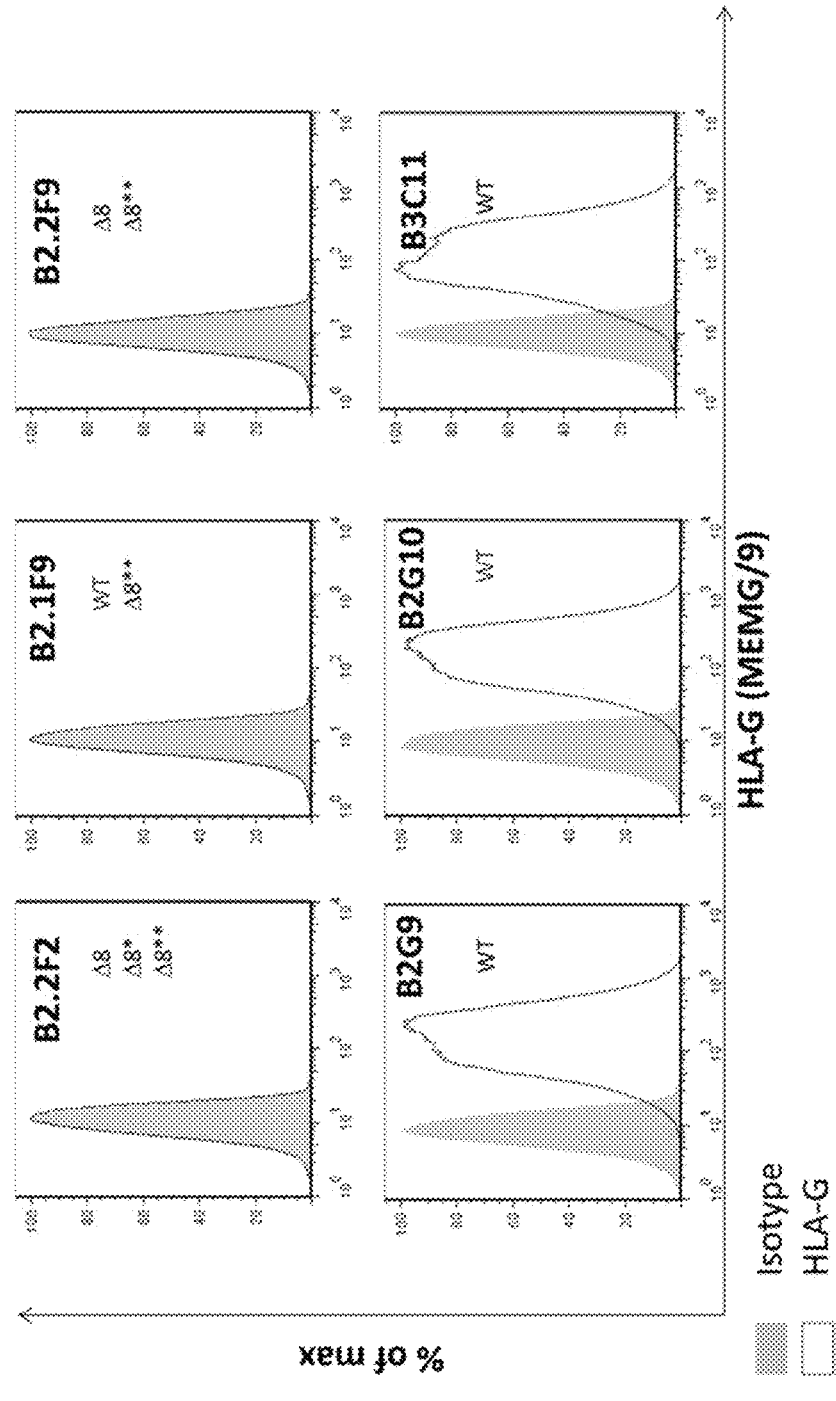
FIG. 22E demonstrates that ΔB2M clones are devoid of HLA-G surface expression.
Figure 22F:
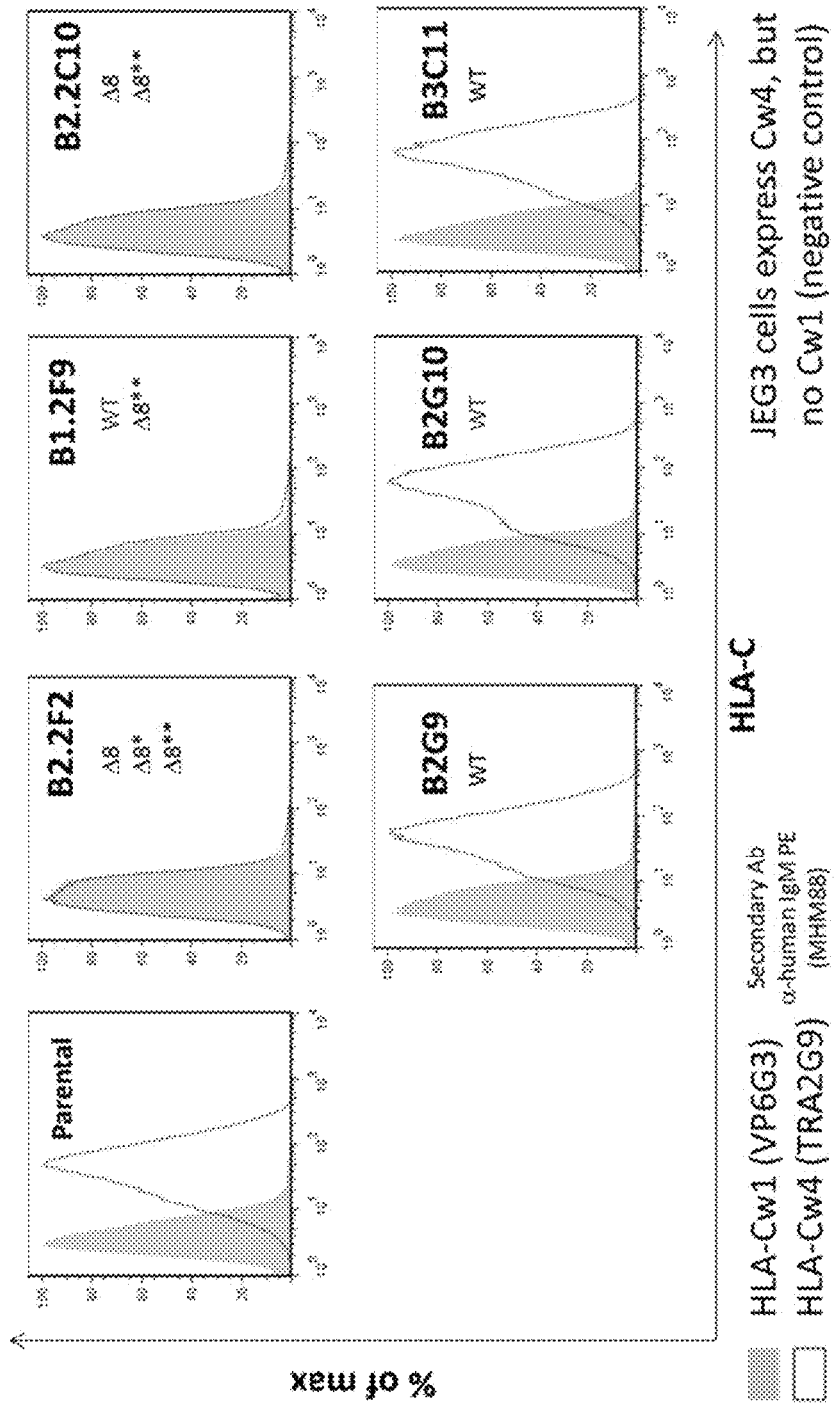
FIG. 22F demonstrates that ΔB2M clones are devoid of HLA-C surface expression.
Figure 22G:
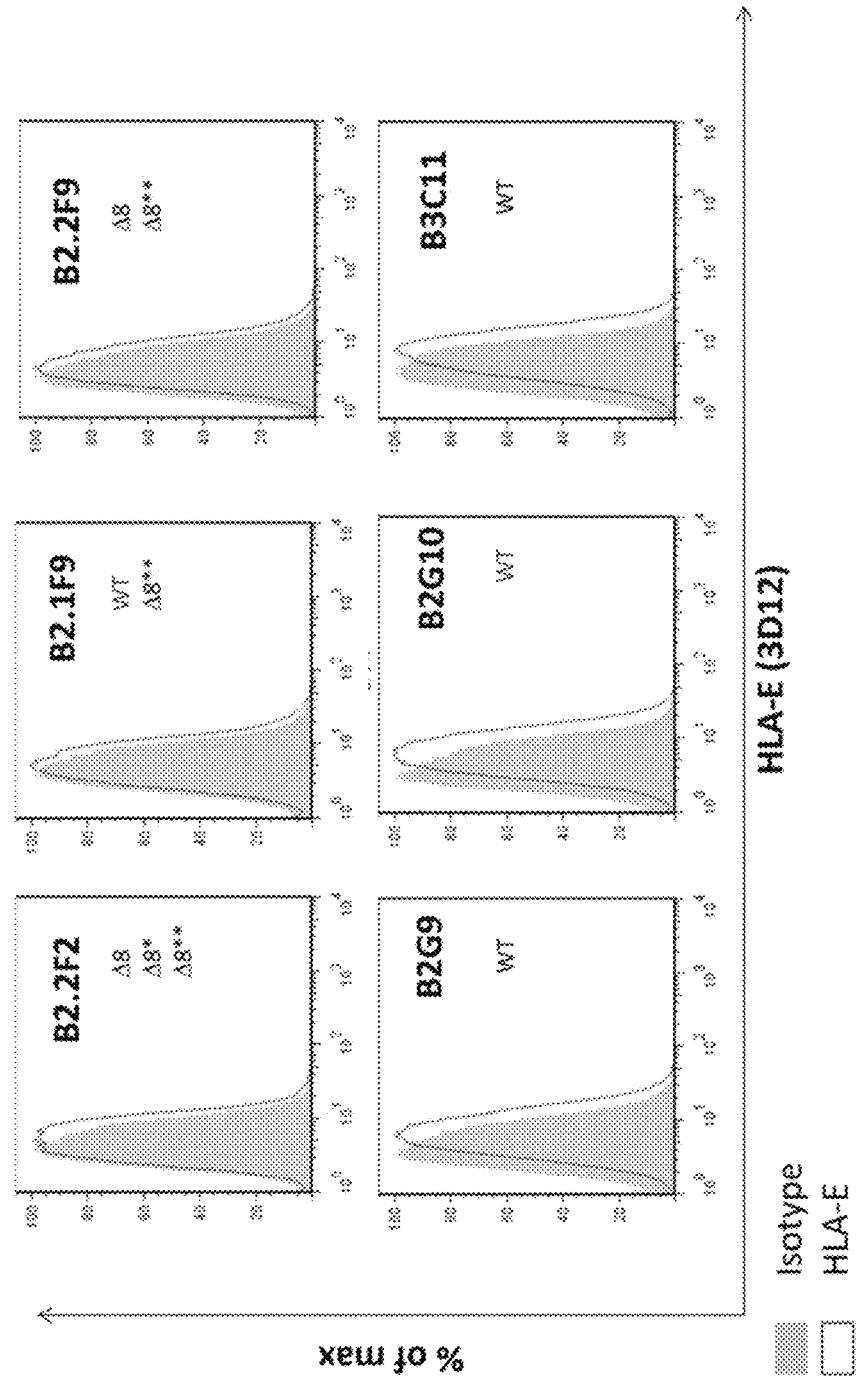
FIG. 22G demonstrates that ΔB2M clones are devoid of HLA-E surface expression.

CRISPR/Cas9 has previously been shown to generate off-target mutations depending upon experimental setting and cell type (Cho et al., 2014; Cradick et al., 2013; Fu et al., 2013; Fu et al., 2014; Hruscha et al., 2013; Lin et al., 2014). To examine this we performed target capture sequencing of CD34+ HSPCs subjected to CRISPR/Cas9 CCR5-editing. These experiments captured each gRNA target site (n=5) and predicted off-target sites (n=126) with expanded capture intervals of 500 base pairs flanking each site to ensure accurate detection of any genetic lesion occurring at or near the selected sites (FIG. 11A). The inventors have previously shown that this approach can also identify structural variations, such as translocations and inversions, in proximity to the capture site (Talkowski et al., 2011). Sorted CD34+ HSPCs treated with Cas9 alone or in combination with multiple single or dual gRNA combinations were sequenced to a mean target coverage of 3,390× across each 23 bp gRNA sequence and PAM (range 379.6×-7,969.5×) (FIG. 11B). Analysis of these data revealed highly efficacious on-target mutagenesis with a diverse array of mutated sequence variants observed in both single and dual gRNA treatments (FIG. 11C). As expected, we detected small InDels of up to 10 bp in addition to single nucleotide substitutions at the predicted target sites in single gRNA conditions. Strikingly, in each dual gRNA experiment, no fewer than 15 alternate mutant alleles were observed at either one of the gRNA sites (FIGS. 13-15). Notably, the sequencing depth of our analysis permitted estimation of mutation frequency for each particular variant, including mutations that were observed in only a few hundredths of a percent of the sample sequenced (FIG. 16). Predicted deletions (i.e. deletions between the two Cas9 target sites) were the most common mutations observed (crCCR5_A+B: 19.95%; crCCR5_C+D: 20.45%; crCCR5_D+42.13%), while small InDels (crCCR5_A+B: 3.06%; crCCR5_C+D: 0.50%; crCCR5_D+Q: 2.95%) were also frequent (FIG. 11C). Interestingly, for two combinations, crCCR5_A+B and crCCR5_D+Q, the inventors also observed inversions between the predicted Cas9 cleavage sites (crCCR5_A+B: 3.06%; crCCR5_D+Q: 2.48%). The most efficacious combination crCCR5_D+Q led to mutations in approximately 48% of the captured sequence reads (FIG. 11C).

We next examined the capture sequence reads at predicted off-target sites in the genome. An N-fold enrichment analysis was performed, wherein we compared the total number of non-reference sequencing reads at each predicted off-target site in gRNA treated and control (Cas9 only) samples. This analysis generated a ratio where 1.0 indicates an equivalent number of non-reference sequence reads in both treated and control samples, values less than 1.0 indicate fewer non-reference reads in treated samples, and values greater than 1.0 indicate a greater number of non-reference reads in treated samples (FIG. 11D). This analysis found that the mean enrichment of mutations at off-target sites in all the gRNA-treated samples compared to control closely conformed to the null hypothesis (i.e., 0.99-fold enrichment compared to controls) indicating that off-target mutation events were extremely rare. Indeed, statistical evaluation of all captured off-target sites yielded a single site (1/126; 0.6%, FIG. 11D) in the sample treated with crCCR5_B alone that passed multiple test correction for a statistically significant enrichment for off-target InDels versus controls ($p \leq 7.6 \times 10^{-11}$). When the inventors scrutinized the sequencing reads from this site, which was located in the highly homologous CCR2 gene (FIG. 9A), we found that all sequence variants (36 out of 5,963 total reads) were one or two base InDels, (FIG. 9B). Of note, the other sample in which crCCR5_B was used (in combination with crCCR5_A) only 13 out of 5,339 reads supported mutation, however these events did not meet statistical significance above controls (FIG. 9B). Thus, off-target mutagenesis was exceedingly rare and moreover, the use of two gRNAs in combination did not increase the very low incidence of off-target mutagenesis. The inventors also performed analyses for structural variation at all sites and though we could readily detect on-target inversions in crCCR5_A+B and crCCR5_D+Q treatments, there was no evidence for inversion or translocation at any off-target sites in any condition. These data indicate that on-target mutagenesis efficiency was very high, and further that off-target mutagenesis was extremely infrequent for both single and dual gRNA treatments.

In this study the inventors utilized the CRISPR/Cas9 system in human primary CD4+ T cells and CD34+ HSPCs to target two clinically relevant genes B2M and CCR5. Surprisingly, the activity of the CRISPR/Cas9 system was remarkably variable in different human cell types, with the same gRNA exhibiting highly efficacious on target mutagenic activity in HEK293T cells but little activity in CD4+ T cells. In contrast, the targeting efficacy in K562 cells and CD34+HSPCs was comparable. Moreover, consistent with previous reports (Hsu et al., 2013) the inventors observed that the efficiency of the CRISPR/Cas9 system was gRNA specific, as even gRNAs with partially overlapping sequences within the same exon displayed significantly different targeting efficiencies. Further, a dual gRNA approach yielded increased gene ablation efficacy in both CD4+ T cells and CD34+ HSPCs leading to predicted deletions at the targeted loci.

The lack of CRISPR/Cas9 activity observed in T cells especially with single gRNAs may be due to a number of factors including, inefficient plasmid DNA delivery, the innate immune response of T cells to foreign nucleic acid (Monroe et al., 2014), and/or active DNA repair machinery. Given the efficacy of the CRISPR/Cas9 system in a wide variety of cell types and species both in vitro and in vivo (Sander and Joung, 2014), the lack of activity observed in T cells is likely the exception and not the rule. Nonetheless, the results highlight that CRISPR/Cas9 targeting efficacy can differ between cell lines and primary cells.

The mutational analysis revealed highly efficacious mutagenesis of on-target sites in CD34+ HSPCs. Single gRNAs generated a range of mutations with the vast majority comprised of small InDels. In contrast, dual gRNA combinations largely led to predicted deletions though a diverse array of mutations including InDels and even inversions were detected. Importantly, we only identified one statistically significant off-target site in the highly homologous CCR2 gene, which occurred in one out of 6 experimental settings (gRNA crCCR5_B alone). Sequence analysis of crCCR5_B in comparison to the identified off-target site in CCR2 indicated that it perfectly matched in the seed region and contained 3 sequence mismatches at the 5' end of the gRNA sequence (positions 1, 4 and 6). This data is consistent with previous studies showing that mismatches in the 5' proximal end of the gRNA are tolerated by Cas9 (Lin et al., 2014; Wu et al., 2014). Our data support the idea that judicious guide design is critical for minimizing off-target mutations. Of note, our very deep sequencing analysis enabled detection of the lone off-target event, whereas analysis performed at lower sequencing depth—such as 50×coverage used in previous studies (Smith et al., 2014; Suzuki et al., 2014; Veres et al., 2014)—would have been unable to detect this event. Overall, our analysis of CRISPR/Cas9 mutational activity in CD34+ HSPCs revealed very high on-target mutation rates and extremely low incidence of off-target mutagenesis.

The ability to direct efficient and predictable deletions using dual gRNAs opens the possibility of using this strategy to target non-coding regions in the genome such as enhancers and silencers that control expression of disease relevant genes. For example, recent studies have identified regulatory regions that control expression of fetal hemoglobin (Bauer et al., 2013), which if deleted increase fetal globin expression in cells otherwise restricted to expressing adult E-globin (Bauer et al., 2013; Xu et al., 2011). Targeted deletion of such regions in CD34+ HSPCs followed by transplantation into patients may provide a durable therapy for the treatment of β-hemoglobinopathies such as sickle cell anemia and β-thalassemia (Xu et al., 2011). Overall, the data demonstrate that CRISPR/Cas9 can be used to ablate genes of clinical significance in CD4+ T cells and CD34+ HSPCs with an efficiency that is therapeutically meaningful for a number of clinical settings, such as the treatment of HIV. Our demonstration that CRISPR/Cas9 targeted CD34+ HSPCs retain multi-lineage potential in vitro and in vivo, combined with very high on-target and minimal off target mutation rates suggests that CRISPR/Cas9 could have broad applicability enabling gene and cell-based therapies of the blood.

SOME EXPERIMENTAL PROCEDURES

Transfection of Cells

Human primary CD4+ T cells and CD34+ HSPCs were transfected with Cas9-2A-GFP and gRNA encoding plasmids using respective Amaxa Nucelofection kits using cell-specific Nucleofection program with Nucleofector II device.

Surveyor Assays

Amplicons spanning the different targeted regions were PCR amplified using the Phusion polymerase and HF Buffer (New England Biolabs) and CEL assay was carried out using the Surveyor Mutation detectionkit (Transgenomic) as per manufacturer's instructions.

In Vivo Transplantation of CD34+ HSPCs 75,000-sorted CD34+ HSPCs expressing Cas9 alone (control group, n=2) or Cas9 with crCCR5_D+Q gRNAs (experimental group, n=5) were transplanted in to NSG recipient mice. At 12 weeks post-transplantation, all mice were euthanized and blood, bone marrow, and spleen samples were taken for characterization of human hematopoietic cell chimerism. Human CD45+ cells were sorted for DNA isolation and analysis of CCR5 deletion.

Off-Target Prediction and Capture Sequencing

Each guide RNA target site (n=5) and predicted off-target site (n=126) was selected for capture sequencing (FIG. 12) using the Agilent SureSelectXT Target Enrichment System. Capture Sequencing was performed as described earlier (Talkowski et al., 2011).

Molecular Biology

We subcloned a human-codon-optimized Cas9 gene with a C-terminal nuclear localization signal (Mali et al., 2013) into a CAG expression plasmid with 2A-GFP (Ding et al., 2013). The guide RNAs (gRNAs) were separately expressed from a plasmid with the human U6 polymerase III promoter (Mali et al., 2013). Each gRNA sequence was introduced in this plasmid using BbsI restriction sites. All guides were designed using the online optimized design tool at http://crispr.mit.edu. gRNA and primer sequences are enlisted under List of reagents at the end of experimental procedures.

Primary Blood Cell Isolation

Primary CD4+ T cells were isolated from peripheral blood (Leukopacs, MGH) using RosetteSep CD4+ T cell enrichment cocktail (STEMCELL Technologies). CD34+ cells from G-CSF mobilized peripheral blood were purchased from AllCells.

Cell Culture

HEK293T, K562 and T cells were cultured in RPMI-1640 medium supplemented with 10% FBS. CD34+ HSPCs were cultured in DMEM/F12 medium supplemented with 10% FBS, β-mercaptoethanol, GlutaMax, Pencillin-Streptomycin, minimum non-essential amino acid and human cytokine cocktails (GM-CSF, SCF, TPO, Flt3 ligand, IL3, IL6). Cell lines were passaged every 3-4 days.

Transfection of Cells

Human primary CD4+ T cells and CD34+ HSPCs were transfected with Cas9-2A-GFP and gRNA encoding plasmids using respective Amaxa Nucelofection kits (Human CD34 cell Nucleofector kit #VPA-1003 for CD34+ HSPCs, Human T cell Nucleofector kit #VPA-1002 for CD4+ T cells, and Cell Line Nucleofector kit V #VCA-1003 for K562 cells) and cell-specific Nucleofection program (U-008 for CD34+ HSPCs, U-014 for CD4+ T cells, and T-016 for K562 cells) with an Amaxa Nucleofection II device as per manufacturer's instructions with minor modifications. HEK293T cells were seeded in 6-well plates the day before transfection and transfected using Fugene 6 (Promega). For dual gRNA combinations in CD34+ HSPCs, individual gRNAs were used at half the amount of single gRNA conditions, keeping total gRNA amount the same across the experimental settings.

Cell Sorting

For the CCR5 targeting experiments in CD34+ HSPCs, cells were thawed and cultivated for 6-8 hours in complete DMEM/F12 medium prior to transfection. Following transfection, cells were plated in antibiotic free medium. 24 hours post-transfection, cells were harvested in sample medium (2% FBS and 2 mM EDTA in PBS without $Ca^{2+}$ and $Mg^{2+}$) and HSPCs were stained with anti-CD34-PE/Cy7 (clone: 581, Biolegend, 1:100) for 20 min on ice. Live, GFP+ CD34+ HSPCs were sorted using an Aria II sorter (BD Bioscience) and plated in complete DMEM/F12 medium supplemented with human cytokine cocktail and culture for 72 hours prior to analysis. For the B2M experiments, cells were stained with mouse monoclonal anti-B2M-APC antibody (clone: 2M2, Biolegend) 48 or 72 hours post-transfection to estimate loss of B2M expression.

FACS data were analyzed using FlowJo software.

Colony Forming Cell (CFC) Assay 1500 sorted CD34+ HSPCs were plated in 1.5 ml of methylcellulose (MethoCult™ H4034 Optimum, Stem Cell Technologies) on a 35 mm cell culture dish and cultured for two weeks at 37° C. in a 5% CO2 incubator. Colonies were then counted and scored.

Surveyor/CEL Assay

Amplicons spanning the different targeted regions were PCR amplified using the Phusion polymerase and HF Buffer (New England Biolabs) and CEL assay was carried out using the Surveyor Mutation detection kit (Transgenomic) according to the manufacturer's instructions, with minor modifications.

Clonal Analysis

Colonies grown in MethoCult™ H4034 Optimum were individually picked and lysed in 50 μl of lysis buffer containing detergent and Proteinase K buffer (van der Burg et al., 2011). Samples were digested at 56° C. for 1 h followed by Proteinase K inactivation at 95° C. for 15 min. 50 μl of water with RNase A were added to the samples. 2 μl of samples were use for PCR. A 436 bp amplicon spanning the targeted region was PCR amplified using GoTaq® Green Master Mix (Promega) as per manufacturer's instructions. For single gRNA experiments, PCR products were analyzed by Sanger sequencing (Macrogen). For dual gRNA experiments, PCR products were analyzed by agarose gel electrophoresis.

In Vivo Transplantation of CD34+ HSPCs

NOD/SCID/IL2Rγ$^{-/-}$ (NSG) mice (The Jackson Laboratory) were housed in a pathogen-free facility, maintained in microisolator cages, and fed autoclaved food and water. Adult (6-8 weeks of age) NSG mice were conditioned with sub-lethal (2 Gy) whole-body irradiation. The conditioned recipients were transplanted with 75,000-sorted CD34+ HSPCs expressing Cas9 alone (control group, n=2) or Cas9 with crCCR5_D+Q gRNAs (experimental group, n=5). At 12 weeks post-transplantation, all mice were euthanized and blood, bone marrow, and spleen samples were taken for characterization of human hematopoietic cell chimerism. Human CD45+ cells were sorted for DNA isolation and analysis of CCR5 deletion.

Single Cell PCR Assay 48 h after electroporation with Cas9 and different gRNA combinations, GFP+ primary CD4+ T cells were sorted into 384-well plates (Twin tec skirted PCR plate, Eppendorf) containing 4 μl of prepGEM Tissue (ZyGEM) per well. Cells were lysed and digested following the manufacturer's instructions to release the genomic DNA. A multiplexed nested PCR was then carried out in the same plate with the primer combinations represented in FIGS. 8C and 8F. The resulting DNA was then used in two subsequent PCR reactions, one amplifying a positive control region, to determine successful genomic DNA isolation from a single cell, and another one amplifying a region lying between the two gRNA binding sites, allowing us to quantify the percentage of cells homozygous for the dual gRNA induced deletion (FIGS. 8D and 8G). Cells were scored based on the melting curves of the PCR amplicons. PCR reactions were performed using an Applied Biosystems ViiA 7 real-Time PCR System (Life Technologies).

Off-Target Prediction and Capture Sequencing

Degenerate gRNA off-target sequences were predicted for each gRNA targeting CCR5 using the CRISPR Design off-target prediction tool (Hsu et al., 2013). Off-target sequences were further supplemented by alignment of each gRNA to the human genome using BOWTIE of which all results up to and including 3 mismatches were added to the total off-target list (Langmead et al., 2009). All instances of each predicted off-target sequence existent in the human genome reference build GRCh37v71 were recorded. Each guide RNA target site (n=5) and predicted off-target site (n=126) was selected for capture sequencing using the Agilent SureSelectXT Target Enrichment System. Capture intervals were expanded by approximately 500 bp in both the 5' and 3' directions to ensure exhaustive capture of the targeted region and detection of any genetic lesion occurring at or near a predicted gRNA on- or off-target site, as we have previously shown accurate capability to detect translocations and inversions using targeted capture of probes in proximity to a rearrangement breakpoint using a CapBP procedure as described (Talkowski et al., 2011). Probes were tiled with 60-fold greater density over each predicted 23 bp on- or off-target gRNA binding site than the flanking kilobase of sequence. Isogenic CD34+ HSPCs-mPB were transfected with CRISPR/Cas9 plasmids (one Cas9 only-treated control group, three treatment groups transfected with a single gRNA, and three treatment groups transfected with dual gRNAs). Sorted CD34+ genome edited HSPCs were cultured for two weeks prior to DNA isolation. Capture libraries were prepared from DNA extracted from seven treatment groups. Capture libraries were sequenced as 101 bp paired-end reads on an Illumina HiSeq2000 platform.

NGS Data Processing and Computational Analysis

Read pairs were aligned to GRCh37v71 with Bwa-MEM v0.7.10-r789 (Li, arXiv 2013). Alignments were processed using PicardTools and SAMBLASTER (Faust and Hall, 2014). The Genome Analysis Toolkit (GATK) v3.1-1-g07a4bf8 was applied for base quality score recalibration, insertion/deletion (InDel) realignment, duplicate removal, and single nucleotide variant (SNV) and InDel discovery and genotyping per published best-practice protocols (McKenna et al, Genome Res 2010; DePristo et al, Nat Genet 2011; Van der Auwera et al, 2013). SNVs and InDels were annotated using ANNOVAR (Wang et al., 2010). Structural variants (SVs) were detected with LUMPY v0.2.5 considering both anomalous pair and split read evidence at a minimum call weight threshold of 7 and an evidence set score ≤0.05 (Layer et al., 2014). Candidate copy number variants (CNVs) were further statistically assessed by Student's t-test for a concomitant change in depth of coverage across the putative CNV. As a final exhaustive measure, each on- and off-target site was manually scrutinized in each capture library for evidence supporting predictable mutagenesis that is not detectable by the computational algorithms due to low levels of mosaicism in the sequenced population.

Evaluation of Off-Target Mutation Frequency

A statistical framework was developed to assess off-target mutational burden for each gRNA. For each off-target site (n=126), all reads with at least one nucleotide of overlap with that 23 bp off-target site were collected and their CIGAR information was tabulated into categories as follows: reads representing small InDels (CIGAR contains at least one "I" or "D"), reads potentially representative of other rearrangements (CIGAR contains at least one "S" or "H"), and reads reflecting reference sequence (CIGAR did not match either of the two former categories). Such counts were gathered at all 126 sites in all seven libraries and were further pooled to form comparison groups of "treatment" libraries (transfected gRNA matches corresponding off-target site gRNA) and "control" libraries (transfected gRNA does not match corresponding off-target site gRNA). Next, at each off-target site, relative n-fold enrichment of each read classification between treatment and control libraries was evaluated. Finally, a one-tailed Fisher's Exact Test was performed to assess the statistical significance of enrichment of variant reads in treatments versus controls at each off-target site, followed by Bonferroni correction to retain an experiment-wide significance threshold of $\alpha=0.05$.

List of Reagents

TABLE 1

PCR primers used for CEL assay

| | | |
|---|---|---|
| Fw: CCR5_CEL_F | CTGCAAAAGGCTGAAGAGCA (SEQ ID NO: 24) | For all guides targeting CCR5 |
| Rev: CCR5_CEL_R | CCCCAAGATGACTATCTTTAATGTC (SEQ ID NO: 25) | |
| Fw: Le277 | CTGGCTTGGAGACAGGTGAC (SEQ ID NO: 26) | For crB2M_6 and crB2M_13 |
| Rev: Le679 | GACGCTTATCACGCCCTAA (SEQ ID NO: 27) | |
| Fw: Le680 | CAAAATCTTGCCGCCTTCCC (SEQ ID NO: 28) | For crB2M_8 |
| Rev: Le681 | ACTTTCCAAAATGAGAGGCATGA (SEQ ID NO: 29) | |
| Fw: Le682 | CCAGAGTGGAAATGGAATTGGGA (SEQ ID NO: 30) | For crB2M_10 |
| Rev: Le683 | ACTCATACACAACTTTCAGCAGCTT (SEQ ID NO: 31) | |
| Fw: Le684 | TCATGGGTAGGAACAGCAGC (SEQ ID NO: 32) | For crB2M_12 |
| Rev: Le685 | TCTCCTCAGCAGAGATGTCC (SEQ ID NO: 33) | |

REFERENCES

1. Allers, K., Hutter, G., Hofmann, J., Loddenkemper, C., Rieger, K., Thiel, E., and Schneider, T. (2011). Evidence for the cure of HIV infection by CCR5Delta32/Delta32 stem cell transplantation. Blood 117, 2791-2799.
2. Bauer, D. E., Kamran, S. C., Lessard, S., Xu, J., Fujiwara, Y., Lin, C., Shao, Z., Canver, M. C., Smith, E. C., Pinello, L., et al. (2013). An erythroid enhancer of BCL11A subject to genetic variation determines fetal hemoglobin level. Science 342, 253-257.
3. Beerman, I., Seita, J., Inlay, M. A., Weissman, I. L., and Rossi, D. J. (2014). Quiescent Hematopoietic Stem Cells Accumulate DNA Damage during Aging that Is Repaired upon Entry into Cell Cycle. Cell stem cell.
4. Bjorkman, P. J., Saper, M. A., Samraoui, B., Bennett, W. S., Strominger, J. L., and Wiley, D. C. (1987). Structure of the human class I histocompatibility antigen, HLA-A2. Nature 329, 506-512.

5. Canver, M. C., Bauer, D. E., Dass, A., Yien, Y. Y., Chung, J., Masuda, T., Maeda, T., Paw, B. H., and Orkin, S. H. (2014). Characterization of Genomic Deletion Efficiency Mediated by Clustered Regularly Interspaced Palindromic Repeats (CRISPR)/Cas9 Nuclease System in Mammalian Cells. The Journal of biological chemistry 289, 21312-21324.
6. Catano, G., Chykarenko, Z. A., Mangano, A., Anaya, J. M., He, W., Smith, A., Bologna, R., Sen, L., Clark, R. A., Lloyd, A., et al. (2011). Concordance of CCR5 genotypes that influence cell-mediated immunity and HIV-1 disease progression rates. The Journal of infectious diseases 203, 263-272.
7. Cho, S. W., Kim, S., Kim, J. M., and Kim, J. S. (2013). Targeted genome engineering in human cells with the Cas9 RNA-guided endonuclease. Nature biotechnology 31, 230-232.
8. Cho, S. W., Kim, S., Kim, Y., Kweon, J., Kim, H. S., Bae, S., and Kim, J. S. (2014). Analysis of off-target effects of CRISPR/Cas-derived RNA-guided endonucleases and nickases. Genome research 24,132-141.
9. Cong, L., Ran, F. A., Cox, D., Lin, S., Barretto, R., Habib, N., Hsu, P. D., Wu, X., Jiang, W., Marraffini, L. A., et al. (2013). Multiplex genome engineering using CRISPR/Cas systems. Science 339, 819-823.
10. Cradick, T. J., Fine, E. J., Antico, C. J., and Bao, G. (2013). CRISPR/Cas9 systems targeting beta-globin and CCR5 genes have substantial off-target activity. Nucleic acids research 41, 9584-9592.
11. Ding, Q., Regan, S. N., Xia, Y., Oostrom, L. A., Cowan, C. A., and Musunuru, K. (2013). Enhanced efficiency of human pluripotent stem cell genome editing through replacing TALENs with CRISPRs. Cell stem cell 12, 393-394.
12. Fu, Y., Foden, J. A., Khayter, C., Maeder, M. L., Reyon, D., Joung, J. K., and Sander, J. D. (2013). High-frequency off-target mutagenesis induced by CRISPR-Cas nucleases in human cells. Nature biotechnology 31, 822-826.
13. Fu, Y., Sander, J. D., Reyon, D., Cascio, V. M., and Joung, J. K. (2014). Improving CRISPR-Cas nuclease specificity using truncated guide RNAs. Nature biotechnology 32, 279-284.
14. Gaj, T., Gersbach, C. A., and Barbas, C. F., 3rd (2013). ZFN, TALEN, and CRISPR/Cas-based methods for genome engineering. Trends in biotechnology 31, 397-405.
15. Gupta, A., Hall, V. L., Kok, F. O., Shin, M., McNulty, J. C., Lawson, N. D., and Wolfe, S. A. (2013). Targeted chromosomal deletions and inversions in zebrafish. Genome research 23, 1008-1017.
16. Holt, N., Wang, J., Kim, K., Friedman, G., Wang, X., Taupin, V., Crooks, G. M., Kohn, D. B., Gregory, P. D., Holmes, M. C., et al. (2010). Human hematopoietic stem/progenitor cells modified by zinc-finger nucleases targeted to CCR5 control HIV-1 in vivo. Nature biotechnology 28, 839-847.
17. Hruscha, A., Krawitz, P., Rechenberg, A., Heinrich, V., Hecht, J., Haass, C., and Schmid, B. (2013). Efficient CRISPR/Cas9 genome editing with low off-target effects in zebrafish. Development 140, 4982-4987.
18. Hsu, P. D., Scott, D. A., Weinstein, J. A., Ran, F. A., Konermann, S., Agarwala, V., Li, Y., Fine, E. J., Wu, X., Shalem, O., et al. (2013). DNA targeting specificity of RNA-guided Cas9 nucleases. Nature biotechnology 31, 827-832.
19. Hutter, G., Nowak, D., Mossner, M., Ganepola, S., Mussig, A., Allers, K., Schneider, T., Hofmann, J., Kucherer, C., Blau, O., et al. (2009). Long-term control of HIV by CCR5 Delta32/Delta32 stem-cell transplantation. The New England journal of medicine 360, 692-698.
20. Hwang, W. Y., Fu, Y., Reyon, D., Maeder, M. L., Tsai, S. Q., Sander, J. D., Peterson, R. T., Yeh, J. R., and Joung, J. K. (2013). Efficient genome editing in zebrafish using a CRISPR-Cas system. Nature biotechnology 31, 227-229.
21. Jinek, M., Chylinski, K., Fonfara, I., Hauer, M., Doudna, J. A., and Charpentier, E. (2012). A programmable dual-RNA-guided DNA endonuclease in adaptive bacterial immunity. Science 337, 816-821.
22. Jinek, M., East, A., Cheng, A., Lin, S., Ma, E., and Doudna, J. (2013). RNA-programmed genome editing in human cells. Elife 2, e00471/
23. Joung, J. K., and Sander, J. D. (2013). TALENs: a widely applicable technology for targeted genome editing. Nature reviews Molecular cell biology 14, 49-55.
24. Lee, H. J., Kim, E., and Kim, J. S. (2010). Targeted chromosomal deletions in human cells using zinc finger nucleases. Genome research 20, 81-89.
25. Lin, Y., Cradick, T. J., Brown, M. T., Deshmukh, H., Ranjan, P., Sarode, N., Wile, B. M., Vertino, P. M., Stewart, F. J., and Bao, G. (2014). CRISPR/Cas9 systems have off-target activity with insertions or deletions between target DNA and guide RNA sequences. Nucleic acids research 42, 7473-7485.
26. Mali, P., Yang, L., Esvelt, K. M., Aach, J., Guell, M., DiCarlo, J. E., Norville, J. E., and Church, G. M. (2013). RNA-guided human genome engineering via Cas9. Science 339, 823-826.
27. Martinson, J. J., Chapman, N. H., Rees, D. C., Liu, Y. T., and Clegg, J. B. (1997). Global distribution of the CCR5 gene 32-basepair deletion. Nature genetics 16, 100-103.
28. Monroe, K. M., Yang, Z., Johnson, J. R., Geng, X., Doitsh, G., Krogan, N. J., and Greene, W. C. (2014). IFI16 DNA sensor is required for death of lymphoid CD4 T cells abortively infected with HIV. Science 343, 428-432.
29. Niu, Y., Shen, B., Cui, Y., Chen, Y., Wang, J., Wang, L., Kang, Y., Zhao, X., Si, W., Li, W., et al. (2014). Generation of Gene-Modified Cynomolgus Monkey via Cas9/RNA-Mediated Gene Targeting in One-Cell Embryos. Cell 156, 836-843.
30. Pan, Y., Xiao, L., Li, A. S., Zhang, X., Sirois, P., Zhang, J., and Li, K. (2013). Biological and biomedical applications of engineered nucleases. Molecular biotechnology 55, 54-62.
31. Perez, E. E., Wang, J., Miller, J. C., Jouvenot, Y., Kim, K. A., Liu, O., Wang, N., Lee, G., Bartsevich, V. V., Lee, Y. L., et al. (2008). Establishment of HIV-1 resistance in CD4+ T cells by genome editing using zinc-finger nucleases. Nature biotechnology 26, 808-816.
32. Riolobos, L., Hirata, R. K., Turtle, C. J., Wang, P. R., Gornalusse, G. G., Zavajlevski, M., Riddell, S. R., and Russell, D. W. (2013). HLA engineering of human pluripotent stem cells. Molecular therapy: the journal of the American Society of Gene Therapy 21, 1232-1241.
33. Samson, M., Libert, F., Doranz, B. J., Rucker, J., Liesnard, C., Farber, C. M., Saragosti, S., Lapoumeroulie, C., Cognaux, J., Forceille, C., et al. (1996). Resistance to HIV-1 infection in caucasian individuals bearing mutant alleles of the CCR-5 chemokine receptor gene. Nature 382, 722-725.
34. Sander, J. D., and Joung, J. K. (2014). CRISPR-Cas systems for editing, regulating and targeting genomes. Nature biotechnology 32, 347-355.

35. Scharenberg, A. M., Duchateau, P., and Smith, J. (2013). Genome engineering with TAL-effector nucleases and alternative modular nuclease technologies. Current gene therapy 13, 291-303.
36. Schleifman, E. B., Bindra, R., Leif, J., del Campo, J., Rogers, F. A., Uchil, P., Kutsch, O., Shultz, L. D., Kumar, P., Greiner, D. L., et al. (2011). Targeted disruption of the CCR5 gene in human hematopoietic stem cells stimulated by peptide nucleic acids. Chemistry & biology 18, 1189-1198.
37. Silva, G., Poirot, L., Galetto, R., Smith, J., Montoya, G., Duchateau, P., and Paques, F. (2011).
38. Meganucleases and other tools for targeted genome engineering: perspectives and challenges for gene therapy. Current gene therapy 11, 11-27.
39. Smith, C., Gore, A., Yan, W., Abalde-Atristain, L., Li, Z., He, C., Wang, Y., Brodsky, R. A., Zhang, K., Cheng, L., et al. (2014). Whole-genome sequencing analysis reveals high specificity of CRISPR/Cas9 and TALEN-based genome editing in human iPSCs. Cell stem cell 15, 12-13.
40. Suzuki, K., Yu, C., Qu, J., Li, M., Yao, X., Yuan, T., Goebl, A., Tang, S., Ren, R., Aizawa, E., et al. (2014).
41. Targeted gene correction minimally impacts whole-genome mutational load in human-disease-specific induced pluripotent stem cell clones. Cell stem cell 15, 31-36.
42. Talkowski, M. E., Ernst, C., Heilbut, A., Chiang, C., Hanscom, C., Lindgren, A., Kirby, A., Liu, S., Muddukrishna, B., Ohsumi, T. K., et al. (2011). Next-generation sequencing strategies enable routine detection of balanced chromosome rearrangements for clinical diagnostics and genetic research. American journal of human genetics 88, 469-481.
43. Tebas, P., Stein, D., Tang, W. W., Frank, I., Wang, S. Q., Lee, G., Spratt, S. K., Surosky, R. T., Giedlin, M. A., Nichol, G., et al. (2014). Gene editing of CCR5 in autologous CD4 T cells of persons infected with HIV. The New England journal of medicine 370, 901-910.
44. Trkola, A., Dragic, T., Arthos, J., Binley, J. M., Olson, W. C., Allaway, G. P., Cheng-Mayer, C., Robinson, J., Maddon, P. J., and Moore, J. P. (1996). CD4-dependent, antibody-sensitive interactions between HIV-1 and its co-receptor CCR-5. Nature 384, 184-187.
45. Urnov, F. D., Rebar, E. J., Holmes, M. C., Zhang, H. S., and Gregory, P. D. (2010). Genome editing with engineered zinc finger nucleases. Nature reviews Genetics 11, 636-646.
46. Veres, A., Gosis, B. S., Ding, Q., Collins, R., Ragavendran, A., Brand, H., Erdin, S., Talkowski, M. E., and Musunuru, K. (2014). Low incidence of off-target mutations in individual CRISPR-Cas9 and TALEN targeted human stem cell clones detected by whole-genome sequencing. Cell stem cell 15, 27-30.
47. Wang, H., Yang, H., Shivalila, C. S., Dawlaty, M. M., Cheng, A. W., Zhang, F., and Jaenisch, R. (2013).
48. One-step generation of mice carrying mutations in multiple genes by CRISPR/Cas-mediated genome engineering. Cell 153, 910-918.
49. Wang, X., Wang, Y., Huang, H., Chen, B., Chen, X., Hu, J., Chang, T., Lin, R. J., and Yee, J. K. (2014). Precise gene modification mediated by TALEN and single-stranded oligodeoxynucleotides in human cells. PloS one 9, e93575.
50. Wei, C., Liu, J., Yu, Z., Zhang, B., Gao, G., and Jiao, R. (2013). TALEN or Cas9-rapid, efficient and specific choices for genome modifications. Journal of genetics and genomics=Yi chuan xue bao 40, 281-289.
51. Wu, X., Scott, D. A., Kriz, A. J., Chiu, A. C., Hsu, P. D., Dadon, D. B., Cheng, A. W., Trevino, A. E., Konermann, S., Chen, S., et al. (2014). Genome-wide binding of the CRISPR endonuclease Cas9 in mammalian cells. Nature biotechnology 32, 670-676.
52. Xu, J., Peng, C., Sankaran, V. G., Shao, Z., Esrick, E. B., Chong, B. G., Ippolito, G. C., Fujiwara, Y., Ebert, B. L., Tucker, P. W., et al. (2011). Correction of sickle cell disease in adult mice by interference with fetal hemoglobin silencing. Science 334, 993-996.
53. Ye, L., Wang, J., Beyer, A. I., Teque, F., Cradick, T. J., Qi, Z., Chang, J. C., Bao, G., Muench, M. O., Yu, J., et al. (2014). Seamless modification of wild-type induced pluripotent stem cells to the natural CCR5Delta32 mutation confers resistance to HIV infection. Proceedings of the National Academy of Sciences of the United States of America 111, 9591-9596.
54. Zhou, J., Wang, J., Shen, B., Chen, L., Su, Y., Yang, J., Zhang, W., Tian, X., and Huang, X. (2014). Dual sgRNAs facilitate CRISPR/Cas9-mediated mouse genome targeting. The FEBS journal 281, 1717-1725.
55. Zijlstra, M., Bix, M., Simister, N. E., Loring, J. M., Raulet, D. H., and Jaenisch, R. (1990). Beta 2-microglobulin deficient mice lack CD4-8+ cytolytic T cells. Nature 344, 742-746.
56. Ding, Q., Lee, Y. K., Schaefer, E. A., Peters, D. T., Veres, A., Kim, K., Kuperwasser, N., Motola, D. L., Meissner, T. B., Hendriks, W. T., et al. (2013). A TALEN genome-editing system for generating human stem cell-based disease models. Cell stem cell 12, 238-251.
57. Faust, G. G., and Hall, I. M. (2014). SAMBLASTER: fast duplicate marking and structural variant read extraction. Bioinformatics 30, 2503-2505.
58. Hsu, P. D., Scott, D. A., Weinstein, J. A., Ran, F. A., Konermann, S., Agarwala, V., Li, Y., Fine, E. J., Wu, X., Shalem, O., et al. (2013). DNA targeting specificity of RNA-guided Cas9 nucleases. Nature biotechnology 31, 827-832.
59. Langmead, B., Trapnell, C., Pop, M., and Salzberg, S. L. (2009). Ultrafast and memory-efficient alignment of short DNA sequences to the human genome. Genome biology 10, R25.
60. Layer, R. M., Chiang, C., Quinlan, A. R., and Hall, I. M. (2014). LUMPY: a probabilistic framework for structural variant discovery. Genome biology 15, R84.
61. Li H. (2013). Aligning sequence reads, clone sequences and assembly contigs with BWA-MEM. arXiv.
62. Mali, P., Yang, L., Esvelt, K. M., Aach, J., Guell, M., DiCarlo, J. E., Norville, J. E., and Church, G. M. (2013). RNA-guided human genome engineering via Cas9. Science 339, 823-826.
63. Talkowski, M. E., Ernst, C., Heilbut, A., Chiang, C., Hanscom, C., Lindgren, A., Kirby, A., Liu, S., Muddukrishna, B., Ohsumi, T. K., et al. (2011). Next-generation sequencing strategies enable routine detection of balanced chromosome rearrangements for clinical diagnostics and genetic research. American journal of human genetics 88, 469-481.
64. Van der Auwera et al. (2013). From FastQ Data to High-Confidence Variant Calls: The Genome Analysis Toolkit Best Practices Pipeline. Current Protocols in Bioinformatics. 43:11.10.1-11.10.33.
65. van der Burg, M., Kreyenberg, H., Willasch, A., Barendregt, B. H., Preuner, S., Watzinger, F., Lion, T., Roosnek, E., Harvey, J., Alcoceba, M., et al. (2011). Standardization of DNA isolation from low cell numbers for chimerism analysis by PCR of short tandem repeats. Leukemia 25, 1467-1470.
66. Wang, K., Li, M., and Hakonarson, H. (2010). ANNOVAR: functional annotation of genetic variants from high-throughput sequencing data. Nucleic acids research 38, e164.

SEQUENCE LISTING (2623 sequences)

SEQ ID NO: 1 - DNA, 2223 bp, Artificial
  B2M sequence
ggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacct

SEQ ID NO: 2 - DNA, 20 bp, Artificial
  target site sequence
gctgccgcccagtgggactt

SEQ ID NO: 3 - DNA, 20 bp, Artificial
  target site sequence
gatctggtaaagatgattcc

SEQ ID NO: 4 - DNA, 20 bp, Artificial
  target site sequence
acaatgtgtcaactcttgac

SEQ ID NO: 5 - DNA, 20 bp, Artificial
  target site sequence
tcactatgctgccgcccagt

SEQ ID NO: 6 - DNA, 20 bp, Artificial
  target site sequence
ggtgacaagtgtgatcactt

SEQ ID NO: 7 - DNA, 20 bp, Artificial
  target site sequence
gacaagtgtgatcacttggg

SEQ ID NO: 8 - DNA, 20 bp, Artificial
  target site sequence
gctgtgtttgcgtctctccc

SEQ ID NO: 9 - DNA, 20 bp, Artificial
  target site sequence
gatgtctcgctccgtggcct

SEQ ID NO: 10 - DNA, 20 bp, Artificial
  target site sequence
ctcgcgctactctctctttc

SEQ ID NO: 11 - DNA, 20 bp, Artificial
  target site sequence
gactcacgctggatagcctc

SEQ ID NO: 12 - DNA, 20 bp, Artificial
  target site sequence
ccagaaagagagagtagcgc

SEQ ID NO: 13 - DNA, 20 bp, Artificial
  target site sequence
cacagctaaggccacggagc

SEQ ID NO: 14 - DNA, 20 bp, Artificial
  target site sequence
ggccgagatgtctcgctccg

SEQ ID NO: 15 - DNA, 20 bp, Artificial
  target site sequence
ttgcgggagcgcatgccttt

SEQ ID NO: 16 - DNA, 20 bp, Artificial
  target site sequence
ccacctcttgatggggctag

SEQ ID NO: 17 - DNA, 20 bp, Artificial
  target site sequence
ataccttgggttgatccact

SEQ ID NO: 18 - DNA, 20 bp, Artificial
  target site sequence
cgtgagtaaacctgaatctt

SEQ ID NO: 19 - DNA, 20 bp, Artificial
  target site sequence
agtcaacttcaatgtcggaa

SEQ ID NO: 20 - DNA, 20 bp, Artificial
  target site sequence
catagatcgagacatgtaag

SEQ ID NO: 21 - DNA, 20 bp, Artificial
  target site sequence
gctactctctctttctggcc

SEQ ID NO: 22 - DNA, 20 bp, Artificial
  target site sequence
acccaaaccaagcctttcta

SEQ ID NO: 23 - DNA, 20 bp, Artificial
  target site sequence
tataagtggaggcgtcgcgc

SEQ ID NO: 24 - DNA, 20 bp, Artificial
  PCR primer
ctgcaaaaggctgaagagca

SEQ ID NO: 25 - DNA, 25 bp, Artificial
  PCR primer
ccccaagatgactatctttaatgtc

SEQ ID NO: 26 - DNA, 20 bp, Artificial
  PCR primer
ctggcttggagacaggtgac

SEQ ID NO: 27 - DNA, 20 bp, Artificial
  PCR primer
gacgcttatcgacgccctaa

SEQ ID NO: 28 - DNA, 20 bp, Artificial
  PCR primer
caaaatcttgccgccttccc

SEQ ID NO: 29 - DNA, 23 bp, Artificial
  PCR primer
actttccaaaatgagaggcatga

SEQ ID NO: 30 - DNA, 23 bp, Artificial
  PCR primer
ccagagtggaaatggaattggga

SEQ ID NO: 31 - DNA, 25 bp, Artificial
  PCR primer
actcatacacaactttcagcagctt

SEQ ID NO: 32 - DNA, 20 bp, Artificial
  PCR primer
tcatgggtaggaacagcagc

SEQ ID NO: 33 - DNA, 20 bp, Artificial
  PCR primer
tctcctcagcagagatgtcc

SEQ ID NO: 34 - DNA, 23 bp, Artificial
  target sequence
gctactctctctttctggcctgg

SEQ ID NO: 35 - DNA, 23 bp, Artificial
  off-target sequence
gctgccgcccagtgggactttgg

SEQ ID NO: 36 - DNA, 23 bp, Artificial
  target sequence
actgtctccctgtagaaaactgg

SEQ ID NO: 37 - DNA, 23 bp, Artificial
  off-target sequence
gatctggtaaagatgattcctgg

SEQ ID NO: 38 - DNA, 23 bp, Artificial
  target sequence
catttagtaaagatgattcctgg

SEQ ID NO: 39 - DNA, 23 bp, Artificial
  off-target sequence
acaatgtgtcaactcttgacagg

SEQ ID NO: 40 - DNA, 21 bp, Artificial
  target sequence
gcattttctgttctctgaagt

SEQ ID NO: 41 - DNA, 22 bp, Artificial
  off-target sequence
tcactatgctgccgcccagtgg

SEQ ID NO: 42 - DNA, 22 bp, Artificial
  target sequence
tcactaggcatgctgccagagc

SEQ ID NO: 43 - DNA, 23 bp, Artificial
  off-target sequence
gctgtgtttgcgtctctcccagg

SEQ ID NO: 44 - DNA, 23 bp, Artificial
  target sequence
gctgtgtttgcttctgtcccagg

SEQ ID NO: 45 - DNA, 23 bp, Artificial
  target sequence
ccacctcttgatggggctagtag

SEQ ID NO: 46 - DNA, 33 bp, Artificial
  target sequence
gctactctctctttctcttgatggggctagtag

SEQ ID NO: 47 - DNA, 23 bp, Artificial
  target sequence
gctgccgcccagtgggactttgg

SEQ ID NO: 48 - DNA, 23 bp, Artificial
  target sequence
ccaggaatcatctttaccagatc

SEQ ID NO: 49 - DNA, 33 bp, Artificial
  target sequence
gctgccgcccagtgggatcatctttaccagatc

SEQ ID NO: 50 - DNA, 23 bp, Artificial
  target sequence
ctccctgggctgcaccatagtga

SEQ ID NO: 51 - DNA, 23 bp, Artificial
  target sequence
gaccttgtgaagatgattcctgg

SEQ ID NO: 52 - DNA, 23 bp, Artificial
  target sequence
gatctggggaagaggattccagg

SEQ ID NO: 53 - DNA, 23 bp, Artificial
  target sequence
agattgtgtatactcttgactag

SEQ ID NO: 54 - DNA, 23 bp, Artificial
  target sequence
ccaggaatcatctctacgatatc

SEQ ID NO: 55 - DNA, 23 bp, Artificial
  target sequence
ccaggaatcatctctacgatatc

SEQ ID NO: 56 - DNA, 23 bp, Artificial
  target sequence
cctggaattctctttactagatc

SEQ ID NO: 57 - DNA, 23 bp, Artificial
  target sequence
ccggggagaggcgcggacacagc

SEQ ID NO: 58 - DNA, 23 bp, Artificial
  target sequence
ccagggagagacggaaccaaaac

SEQ ID NO: 59 - DNA, 23 bp, Artificial
  target sequence
gatctgatacagatgattcatgg

SEQ ID NO: 60 - DNA, 23 bp, Artificial
  target sequence
ctgggaatcatctttacaagatg

SEQ ID NO: 61 - DNA, 23 bp, Artificial
  target sequence
tgaatatcctgtcgcccagtcag

SEQ ID NO: 62 - DNA, 23 bp, Artificial
  target sequence
ccacccaagtgatcactcttcct

SEQ ID NO: 63 - DNA, 23 bp, Artificial
  target sequence
aggaagagtgatcacttgggtgg

SEQ ID NO: 64 - DNA, 23 bp, Artificial
  target sequence
tctgtgtttttgtctctccccag

SEQ ID NO: 65 - DNA, 23 bp, Artificial
  target sequence
tctgtgtttttgtctctccccag

SEQ ID NO: 66 - DNA, 23 bp, Artificial
  target sequence
aggaagagtgatcacttgggtgg

SEQ ID NO: 67 - DNA, 23 bp, Artificial
  target sequence
ccacccaagtgatcactcttcct

SEQ ID NO: 68 - DNA, 23 bp, Artificial
  target sequence
ctaggaatcatcttccccagatg

SEQ ID NO: 69 - DNA, 23 bp, Artificial
  target sequence
tctgtggaaaagatgattccaag

SEQ ID NO: 70 - DNA, 23 bp, Artificial
  target sequence
gttcttgttaagatgattcctgg

SEQ ID NO: 71 - DNA, 23 bp, Artificial
  target sequence
gttcttgttaagatgattcctgg

SEQ ID NO: 72 - DNA, 23 bp, Artificial
  target sequence
ggcatgtttcatcacttgggggg

SEQ ID NO: 73 - DNA, 23 bp, Artificial
  target sequence
gggctggtaaagatgtttccagg

SEQ ID NO: 74 - DNA, 23 bp, Artificial
  target sequence
gacaagtgtgatcacctggttgg

SEQ ID NO: 75 - DNA, 23 bp, Artificial
  target sequence
gctgtgtttgcttctgtcccagg

SEQ ID NO: 76 - DNA, 23 bp, Artificial
  target sequence
ccaggaatcatctttactaaatg

SEQ ID NO: 77 - DNA, 23 bp, Artificial
  target sequence
ccaggaatcatctttactaaatg

SEQ ID NO: 78 - DNA, 23 bp, Artificial
  target sequence
tcactatgctgccgcccagtggg

SEQ ID NO: 79 - DNA, 23 bp, Artificial
  target sequence
gctgccgcccagtgggactttgg

SEQ ID NO: 80 - DNA, 23 bp, Artificial
  target sequence
acaatgtgtcaactcttgacagg

SEQ ID NO: 81 - DNA, 23 bp, Artificial
  target sequence
gacaagtgtgatcacttgggtgg

SEQ ID NO: 82 - DNA, 23 bp, Artificial
  target sequence
gctgtgtttgcgtctctcccagg

SEQ ID NO: 83 - DNA, 23 bp, Artificial
  target sequence
ccaggaatcatctttaccagatc

SEQ ID NO: 84 - DNA, 23 bp, Artificial
  target sequence
acaaggggtcaactctggacaag

SEQ ID NO: 85 - DNA, 23 bp, Artificial
  target sequence
acaaggggtcaactctggacaag

SEQ ID NO: 86 - DNA, 23 bp, Artificial
  target sequence
cccactgggctgcagcatcctgg

SEQ ID NO: 87 - DNA, 23 bp, Artificial
  target sequence
ccagcgcgtgacgcaaacacagc

SEQ ID NO: 88 - DNA, 23 bp, Artificial
  target sequence
acaatgtgtcaccttttaactgg

SEQ ID NO: 89 - DNA, 23 bp, Artificial
  target sequence
acaatatttcaacacttgacaag

SEQ ID NO: 90 - DNA, 23 bp, Artificial
  target sequence
cttggagtcatctttgccacatc

SEQ ID NO: 91 - DNA, 23 bp, Artificial
  target sequence
gacaagcgtgatcccatggggag

SEQ ID NO: 92 - DNA, 23 bp, Artificial
  target sequence
cctcccaagtaatcacccttttc

SEQ ID NO: 93 - DNA, 23 bp, Artificial
  target sequence
cccaagtcccactggcaggtggc

SEQ ID NO: 94 - DNA, 23 bp, Artificial
  target sequence
gctatgtgttaactcttgacaag

SEQ ID NO: 95 - DNA, 23 bp, Artificial
  target sequence
gctatgtgttaactcttgacaag

SEQ ID NO: 96 - DNA, 23 bp, Artificial
  target sequence
ccactatggtgcctcccagtcag

SEQ ID NO: 97 - DNA, 23 bp, Artificial
  target sequence
tcactctgctgctgtccagtggg

SEQ ID NO: 98 - DNA, 23 bp, Artificial
  target sequence
actctgtcctgccgcccagtgag

SEQ ID NO: 99 - DNA, 23 bp, Artificial
  target sequence
cttggaatcatctctacctgatt

SEQ ID NO: 100 - DNA, 23 bp, Artificial
  target sequence
cccaagtcccactgggtgacatg

SEQ ID NO: 101 - DNA, 23 bp, Artificial
  target sequence
ctaaggagagaggcacacacagc

SEQ ID NO: 102 - DNA, 23 bp, Artificial
  target sequence
ccagggagggacgcaaacccagc

SEQ ID NO: 103 - DNA, 23 bp, Artificial
  target sequence
ccagggagggacgcaaacccagc

SEQ ID NO: 104 - DNA, 23 bp, Artificial
  target sequence
cttctcaagtgatcccactggtc

SEQ ID NO: 105 - DNA, 23 bp, Artificial
  target sequence
cctgagagagaagcaaacacaga

SEQ ID NO: 106 - DNA, 23 bp, Artificial
  target sequence
cttaggaaagacgcaaacatagc

SEQ ID NO: 107 - DNA, 23 bp, Artificial
  target sequence
acattgattaaactcttgactag

SEQ ID NO: 108 - DNA, 23 bp, Artificial
  target sequence
acaaagtttaaactcttgagcag

SEQ ID NO: 109 - DNA, 23 bp, Artificial
  target sequence
cttcccaagtgattacactttat

SEQ ID NO: 110 - DNA, 23 bp, Artificial
  target sequence
cccactggggcgcagcctagtga

SEQ ID NO: 111 - DNA, 23 bp, Artificial
  target sequence
cttgtcaagatttgccacattat

SEQ ID NO: 112 - DNA, 23 bp, Artificial
  target sequence
cttgtcaagatttgccacattat

SEQ ID NO: 113 - DNA, 23 bp, Artificial
  target sequence
ccttggtgagaggcaaacacagc

SEQ ID NO: 114 - DNA, 23 bp, Artificial
  target sequence
cctactgggcgtcagcactgtgt

SEQ ID NO: 115 - DNA, 23 bp, Artificial
  target sequence
tcactatgcagcaccccagtggg

SEQ ID NO: 116 - DNA, 23 bp, Artificial
  target sequence
ccaggcatcttctttaccagctc

SEQ ID NO: 117 - DNA, 23 bp, Artificial
  target sequence
ctcactgggctgcagcattgggg

SEQ ID NO: 118 - DNA, 23 bp, Artificial
  target sequence
ccagggagagacgcagaaacaac

SEQ ID NO: 119 - DNA, 23 bp, Artificial
  target sequence
ccagggagagacgcagaaacaac

SEQ ID NO: 120 - DNA, 23 bp, Artificial
  target sequence
tacatgagtaatcacttggggag

SEQ ID NO: 121 - DNA, 23 bp, Artificial
  target sequence
ctccccaagtgattactcatgta

SEQ ID NO: 122 - DNA, 23 bp, Artificial
  target sequence
ctccccaagtgattactcatgta

SEQ ID NO: 123 - DNA, 23 bp, Artificial
  target sequence
tacatgagtaatcacttggggag

SEQ ID NO: 124 - DNA, 23 bp, Artificial
  target sequence
ctccccaagtgattactcatgta

SEQ ID NO: 125 - DNA, 23 bp, Artificial
  target sequence
ctccccaagtgattactcatgta

SEQ ID NO: 126 - DNA, 23 bp, Artificial
  target sequence
tacatgagtaatcacttggggag

SEQ ID NO: 127 - DNA, 23 bp, Artificial
  target sequence
ctccccaagtgattactcatgta

SEQ ID NO: 128 - DNA, 23 bp, Artificial
  target sequence
ctccccaagtgattactcatgta

SEQ ID NO: 129 - DNA, 23 bp, Artificial
  target sequence
tacatgagtaatcacttggggag

SEQ ID NO: 130 - DNA, 23 bp, Artificial
  target sequence
ctccccaagtgattactcatgta

SEQ ID NO: 131 - DNA, 23 bp, Artificial
  target sequence
ctccccaagtgattactcatgta

SEQ ID NO: 132 - DNA, 23 bp, Artificial
  target sequence
cagaggtgtgatcacttgggcag

SEQ ID NO: 133 - DNA, 23 bp, Artificial
  target sequence
cagaggtgtgatcacttgggcag

SEQ ID NO: 134 - DNA, 23 bp, Artificial
  target sequence
cttcccatgtgataacacttgtc

SEQ ID NO: 135 - DNA, 23 bp, Artificial
  target sequence
cttcccatgtgataacacttgtc

SEQ ID NO: 136 - DNA, 23 bp, Artificial
  target sequence
cctgagagagaggcaaacacatc

SEQ ID NO: 137 - DNA, 23 bp, Artificial
  target sequence
ccacgaatcctctttaccaaatc

SEQ ID NO: 138 - DNA, 23 bp, Artificial
  target sequence
ctccccaagtgattactcatgta

SEQ ID NO: 139 - DNA, 23 bp, Artificial
  target sequence
tacatgagtaatcacttggggag

SEQ ID NO: 140 - DNA, 23 bp, Artificial
  target sequence
ctccccaagtgattactcatgta

SEQ ID NO: 141 - DNA, 23 bp, Artificial
  target sequence
cctgagggtgcgtctctcccggg

SEQ ID NO: 142 - DNA, 23 bp, Artificial
  target sequence
gctgtgtgctcgtctctccctgg

SEQ ID NO: 143 - DNA, 23 bp, Artificial
  target sequence
gctgtgtgctcgtctctccctgg

SEQ ID NO: 144 - DNA, 23 bp, Artificial
  target sequence
gctgcggcccagcgggacctggg

SEQ ID NO: 145 - DNA, 23 bp, Artificial
  target sequence
gctgtacttgggtctctccccag

SEQ ID NO: 146 - DNA, 23 bp, Artificial
  target sequence
gccgtgttttcctctctcccaag

SEQ ID NO: 147 - DNA, 23 bp, Artificial
  target sequence
gccgtgttttcctctctcccaag

SEQ ID NO: 148 - DNA, 23 bp, Artificial
  target sequence
cccactgggctgcagaatacaga

SEQ ID NO: 149 - DNA, 23 bp, Artificial
  target sequence
ccccccaggagatcacatttgtc

SEQ ID NO: 150 - DNA, 23 bp, Artificial
  target sequence
gctgccggacagtgggacctggg

SEQ ID NO: 151 - DNA, 23 bp, Artificial
  target sequence
ctgactggacggcaccttagtga

SEQ ID NO: 152 - DNA, 23 bp, Artificial
  target sequence
gctgtcttttcctctctccctgg

SEQ ID NO: 153 - DNA, 23 bp, Artificial
  target sequence
ccagaaataatctttaccagctc

SEQ ID NO: 154 - DNA, 23 bp, Artificial
  target sequence
gctgtgtttgtgcctcccccagg

SEQ ID NO: 155 - DNA, 23 bp, Artificial
  target sequence
acaatgtgttggctcttgactag

SEQ ID NO: 156 - DNA, 23 bp, Artificial
  target sequence
acaatgtgttggctcttgactag

SEQ ID NO: 157 - DNA, 23 bp, Artificial
  target sequence
gacaagtctgatcattttggggg

SEQ ID NO: 158 - DNA, 23 bp, Artificial
  target sequence
ccacggagaaacacaaacacagc

SEQ ID NO: 159 - DNA, 23 bp, Artificial
  target sequence
aaaatgtgtcaactcttgattag

SEQ ID NO: 160 - DNA, 23 bp, Artificial
  target sequence
aaaatgtgtcaactcttgattag

SEQ ID NO: 161 - DNA, 23 bp, Artificial
  target sequence
tctgtgtttgcctctctctcagg

SEQ ID NO: 162 - DNA, 23 bp, Artificial
  target sequence
acaatgtgccagctctggactag

SEQ ID NO: 163 - DNA, 23 bp, Artificial
  target sequence
gacaagtatgagcacttggtaag

SEQ ID NO: 164 - DNA, 23 bp, Artificial
  target sequence
gactagtgtgttctcttgggaag

SEQ ID NO: 165 - DNA, 23 bp, Artificial
  target sequence
gacatgtgtaaacacttgggaag

SEQ ID NO: 166 - DNA, 23 bp, Artificial
  target sequence
gacatgtgtaaacacttgggaag

SEQ ID NO: 167 - DNA, 23 bp, Artificial
  target sequence
ccaaagtcccactgggtgacatc

SEQ ID NO: 168 - DNA, 23 bp, Artificial
  target sequence
ccaaagtcccactgggtgacatc

SEQ ID NO: 169 - DNA, 23 bp, Artificial
  target sequence
cctgtgagaggctcaaacacagc

SEQ ID NO: 170 - DNA, 23 bp, Artificial
  target sequence
ccgcagtcccactgtgcggcacc

SEQ ID NO: 171 - DNA, 23 bp, Artificial
  target sequence
ccgcagtcccactgtgcggcacc

SEQ ID NO: 172 - DNA, 23 bp, Artificial
  target sequence
gacaagtgtgttcacttctgcag

SEQ ID NO: 173 - DNA, 23 bp, Artificial
  target sequence
gatttgggaaagatcattccagg

SEQ ID NO: 174 - DNA, 23 bp, Artificial
  target sequence
gctttggtaaagttgattcctag

SEQ ID NO: 175 - DNA, 23 bp, Artificial
  target sequence
aaactgtgataactcttgactgg

SEQ ID NO: 176 - DNA, 23 bp, Artificial
  target sequence
cctaagtcccactggccgaaagt

SEQ ID NO: 177 - DNA, 23 bp, Artificial
  target sequence
gttctggtcaagatgactcctgg

SEQ ID NO: 178 - DNA, 23 bp, Artificial
  target sequence
cccaggacccactgggcagcagc

SEQ ID NO: 179 - DNA, 23 bp, Artificial
  target sequence
aaaatctgtcaactcttgaatag

SEQ ID NO: 180 - DNA, 23 bp, Artificial
  target sequence
aaaatctgtcaactcttgaatag

SEQ ID NO: 181 - DNA, 23 bp, Artificial
  target sequence
ctcatcaggagtggacacattgt

SEQ ID NO: 182 - DNA, 23 bp, Artificial
  target sequence
ccagggggacacgcaaacactgc

SEQ ID NO: 183 - DNA, 23 bp, Artificial
  target sequence
tcactttgctgccagccagttgg

SEQ ID NO: 184 - DNA, 23 bp, Artificial
  target sequence
ctgaagtcccactgggtgggtgt

SEQ ID NO: 185 - DNA, 23 bp, Artificial
  target sequence
gcaccagcccagtgggacttcag

SEQ ID NO: 186 - DNA, 23 bp, Artificial
  target sequence
gcaccagcccagtgggacttcag

SEQ ID NO: 187 - DNA, 23 bp, Artificial
  target sequence
gcaccagcccagtgggacttcag

SEQ ID NO: 188 - DNA, 23 bp, Artificial
  target sequence
gcaccagcccagtgggacttcag

SEQ ID NO: 189 - DNA, 23 bp, Artificial
  target sequence
ccagggaaagaggcaagcacagc

SEQ ID NO: 190 - DNA, 23 bp, Artificial
  target sequence
ccactatacacccgcccagtcag

SEQ ID NO: 191 - DNA, 23 bp, Artificial
  target sequence
ccattgtgctgccgcccagccag

SEQ ID NO: 192 - DNA, 23 bp, Artificial
  target sequence
gatctggaagagatgattccaag

SEQ ID NO: 193 - DNA, 23 bp, Artificial
  target sequence
cccgggagggaggcaaaaacagc

SEQ ID NO: 194 - DNA, 23 bp, Artificial
  target sequence
gctgagtctgggtctctccccag

SEQ ID NO: 195 - DNA, 23 bp, Artificial
  target sequence
gctgagtctgggtctctccccag

SEQ ID NO: 196 - DNA, 23 bp, Artificial
  target sequence
cctggaatgttctttcccagatc

SEQ ID NO: 197 - DNA, 23 bp, Artificial
  target sequence
cctggaatgttctttcccagatc

SEQ ID NO: 198 - DNA, 23 bp, Artificial
  target sequence
gacaggtgtgagcactttgggag

SEQ ID NO: 199 - DNA, 23 bp, Artificial
  target sequence
gacacttgtgatgacttgggtag

SEQ ID NO: 200 - DNA, 23 bp, Artificial
  target sequence
ctttggagagacgcagacactgc

SEQ ID NO: 201 - DNA, 23 bp, Artificial
  target sequence
ctttggagagacgcagacactgc

SEQ ID NO: 202 - DNA, 23 bp, Artificial
  target sequence
cctggaatgttctttcccagatc

SEQ ID NO: 203 - DNA, 23 bp, Artificial
  target sequence
cctggaatgttctttcccagatc

SEQ ID NO: 204 - DNA, 23 bp, Artificial
  target sequence
ctacccaagtgttcatatttgtc

SEQ ID NO: 205 - DNA, 23 bp, Artificial
  target sequence
ccagaaatcatgtttaccagctc

SEQ ID NO: 206 - DNA, 23 bp, Artificial
  target sequence
ctggagtcccactgcgcggcagc

SEQ ID NO: 207 - DNA, 23 bp, Artificial
  target sequence
cctgggaaaggcgcaaacacagc

SEQ ID NO: 208 - DNA, 23 bp, Artificial
  target sequence
gatctgataaaggtgagtccagg

SEQ ID NO: 209 - DNA, 23 bp, Artificial
  target sequence
gcaagttgctgccgcccagtggg

SEQ ID NO: 210 - DNA, 23 bp, Artificial
  target sequence
tacatgagtaatcacttggggag

SEQ ID NO: 211 - DNA, 23 bp, Artificial
  target sequence
ctccccaagtgattactcatgta

SEQ ID NO: 212 - DNA, 23 bp, Artificial
  target sequence
ctccccaagtgattactcatgta

SEQ ID NO: 213 - DNA, 23 bp, Artificial
  target sequence
gcagtgtgtgggtctctcccagg

SEQ ID NO: 214 - DNA, 23 bp, Artificial
  target sequence
gcagtgtgtgggtctctcccagg

SEQ ID NO: 215 - DNA, 23 bp, Artificial
  target sequence
tacatgagtaatcacttggggag

SEQ ID NO: 216 - DNA, 23 bp, Artificial
  target sequence
ctccccaagtgattactcatgta

SEQ ID NO: 217 - DNA, 23 bp, Artificial
  target sequence
ctccccaagtgattactcatgta

SEQ ID NO: 218 - DNA, 23 bp, Artificial
  target sequence
ccaaagtcgcactggcctgcagc

SEQ ID NO: 219 - DNA, 23 bp, Artificial
  target sequence
gatctgggagagaagattccagg

SEQ ID NO: 220 - DNA, 23 bp, Artificial
  target sequence
ccagaaaagagttgacacatagt

SEQ ID NO: 221 - DNA, 23 bp, Artificial
  target sequence
cctgccaagggttgacacatggt

SEQ ID NO: 222 - DNA, 23 bp, Artificial
  target sequence
gacaagtgtcataactttggaag

SEQ ID NO: 223 - DNA, 23 bp, Artificial
  target sequence
ataatgtgtcaaccctggaccag

SEQ ID NO: 224 - DNA, 23 bp, Artificial
  target sequence
ccaaagacccactggacggcagc

SEQ ID NO: 225 - DNA, 23 bp, Artificial
  target sequence
ccaaagacccactggacggcagc

SEQ ID NO: 226 - DNA, 23 bp, Artificial
  target sequence
ccaactggccggcagcctggtga

SEQ ID NO: 227 - DNA, 23 bp, Artificial
  target sequence
ccaactggccggcagcctggtga

SEQ ID NO: 228 - DNA, 45 bp, Artificial
  target sequence
tatgctgccgcccagtgggactttggaaatacaatgtgtcaactc

SEQ ID NO: 229 - DNA, 45 bp, Artificial
  target sequence
ggctgtgtttgcgtctctcccaggaatcatctttaccagatctca

SEQ ID NO: 230 - DNA, 20 bp, Artificial
  target sequence
tatgctgccgcccagtggga

SEQ ID NO: 231 - DNA, 25 bp, Artificial
  target sequence
atcatctttaccagatctcaaaaag

SEQ ID NO: 232 - DNA, 25 bp, Artificial
  target sequence
gagttgacacattgtatttccaaag

SEQ ID NO: 233 - DNA, 20 bp, Artificial
  target sequence
atcatctttaccagatctca

SEQ ID NO: 234 - DNA, 20 bp, Artificial
  target sequence
tatgctgccgcccagtggga

SEQ ID NO: 235 - DNA, 25 bp, Artificial
  target sequence
tcctgggagagacgcaaacacagcc

SEQ ID NO: 236 - DNA, 25 bp, Artificial
  target sequence
tggctgtgtttgcgtctctcccagg

SEQ ID NO: 237 - DNA, 20 bp, Artificial
  target sequence
atcatctttaccagatctca

SEQ ID NO: 238 - DNA, 20 bp, Artificial
  target sequence
tatgctgccgcccagtggga

SEQ ID NO: 239 - DNA, 25 bp, Artificial
  target sequence
catcatctttaccagatctcaaaaa

SEQ ID NO: 240 - DNA, 20 bp, Artificial
  target sequence
tatgctgccgcccagtggga

SEQ ID NO: 241 - DNA, 25 bp, Artificial
  target sequence
tttggaaatacaatgtgtcaactct

SEQ ID NO: 242 - DNA, 20 bp, Artificial
  target sequence
tatgctgccgcccagtggga

SEQ ID NO: 243 - DNA, 25 bp, Artificial
  target sequence
tcatctttaccagatctcaaaaaga

SEQ ID NO: 244 - DNA, 25 bp, Artificial
  target sequence
gctgtgtttgcgtctctcccaggaa

SEQ ID NO: 245 - DNA, 20 bp, Artificial
  target sequence
atcatctttaccagatctca

SEQ ID NO: 246 - DNA, 20 bp, Artificial
  target sequence
tatgctgccgcccagtggga

SEQ ID NO: 247 - DNA, 25 bp, Artificial
  target sequence
actttggaaatacaatgtgtcaact

SEQ ID NO: 248 - DNA, 20 bp, Artificial
  target sequence
tatgctgccgcccagtggga

SEQ ID NO: 249 - DNA, 25 bp, Artificial
  target sequence
tggaaatacaatgtgtcaactcttg

SEQ ID NO: 250 - DNA, 25 bp, Artificial
  target sequence
gtggctgtgtttgcgtctctcccag

SEQ ID NO: 251 - DNA, 20 bp, Artificial
  target sequence
atcatctttaccagatctca

SEQ ID NO: 252 - DNA, 20 bp, Artificial
  target sequence
tatgctgccgcccagtggga

SEQ ID NO: 253 - DNA, 25 bp, Artificial
  target sequence
tcctttggaaatacaatgtgtcaac

SEQ ID NO: 254 - DNA, 20 bp, Artificial
  target sequence
tatgctgccgcccagtggga

SEQ ID NO: 255 - DNA, 25 bp, Artificial
  target sequence
atctttaccagatctcaaaaagaag

SEQ ID NO: 256 - DNA, 25 bp, Artificial
  target sequence
tggtggctgtgtttgcgtctctccc

SEQ ID NO: 257 - DNA, 20 bp, Artificial
  target sequence
atcatctttaccagatctca

SEQ ID NO: 258 - DNA, 20 bp, Artificial
  target sequence
tatgctgccgcccagtggga

SEQ ID NO: 259 - DNA, 25 bp, Artificial
  target sequence
aatcatctttaccagatctcaaaaa

SEQ ID NO: 260 - DNA, 25 bp, Artificial
  target sequence
tcactatgctgccgcccagtgggaa

SEQ ID NO: 261 - DNA, 20 bp, Artificial
  target sequence
atcatctttaccagatctca

SEQ ID NO: 262 - DNA, 20 bp, Artificial
  target sequence
tatgctgccgcccagtggga

SEQ ID NO: 263 - DNA, 25 bp, Artificial
  target sequence
aatgtgtcaactcttgacagggctc

SEQ ID NO: 264 - DNA, 20 bp, Artificial
  target sequence
tatgctgccgcccagtggga

SEQ ID NO: 265 - DNA, 25 bp, Artificial
  target sequence
ttggaaatacaatgtgtcaactctt

SEQ ID NO: 266 - DNA, 25 bp, Artificial
  target sequence
gagttacatgatcccccatgttgtg

SEQ ID NO: 267 - DNA, 20 bp, Artificial
  target sequence
atcatctttaccagatctca

SEQ ID NO: 268 - DNA, 25 bp, Artificial
  target sequence
gtggtggctgtgtttgcgtctcccc

SEQ ID NO: 269 - DNA, 20 bp, Artificial
  target sequence
atcatctttaccagatctca

SEQ ID NO: 270 - DNA, 45 bp, Artificial
  target sequence
ggctgtgtttgcgtctctcccaggtatcatctttaccagatctca

SEQ ID NO: 271 - DNA, 20 bp, Artificial
  target sequence
tatgctgccgcccagtggga

SEQ ID NO: 272 - DNA, 25 bp, Artificial
  target sequence
catctttaccagatctcaaaaagaa

SEQ ID NO: 273 - DNA, 20 bp, Artificial
  target sequence
tatgctgccgcccagtggga

SEQ ID NO: 274 - DNA, 25 bp, Artificial
  target sequence
aatacaatgtgtcaactcttgacag

SEQ ID NO: 275 - DNA, 20 bp, Artificial
  target sequence
tatgctgccgcccagtggga

SEQ ID NO: 276 - DNA, 25 bp, Artificial
  target sequence
atacaatgtgtcaactcttgacagg

SEQ ID NO: 277 - DNA, 45 bp, Artificial
  target sequence
tatgctgccgcccagtgggattttggaaatacaatgtttcaactc

SEQ ID NO: 278 - DNA, 45 bp, Artificial
  target sequence
atacaatgtgtcaactcttgacagggctctattttataggcttct

SEQ ID NO: 279 - DNA, 45 bp, Artificial
  target sequence
ggctcactatgctgccgcccagtgggactttggaaatacaatgtg

SEQ ID NO: 280 - DNA, 20 bp, Artificial
  target sequence
ggctcactatgctgccgccc

SEQ ID NO: 281 - DNA, 25 bp, Artificial
  target sequence
gacagggctctattttataggcttc

SEQ ID NO: 282 - DNA, 20 bp, Artificial
  target sequence
ggctcactatgctgccgccc

SEQ ID NO: 283 - DNA, 25 bp, Artificial
  target sequence
tgacagggctctattttataggctt

SEQ ID NO: 284 - DNA, 20 bp, Artificial
  target sequence
ggctcactatgctgccgccc

SEQ ID NO: 285 - DNA, 25 bp, Artificial
  target sequence
ttgacagggctctattttataggct

SEQ ID NO: 286 - DNA, 19 bp, Artificial
  target sequence
aatacaatgtgtcaactct

SEQ ID NO: 287 - DNA, 26 bp, Artificial
  target sequence
gacagggctctattttataggcttct

SEQ ID NO: 288 - DNA, 45 bp, Artificial
  target sequence
ggctcactatgctgccgcccagggggactttggaaatacaatgtg

SEQ ID NO: 289 - DNA, 20 bp, Artificial
  target sequence
ggctcactatgctgccgccc

SEQ ID NO: 290 - DNA, 25 bp, Artificial
  target sequence
gggactttggaaatacaatgtgtca

SEQ ID NO: 291 - DNA, 19 bp, Artificial
  target sequence
ccggcaaacaaaccaccgc

SEQ ID NO: 292 - DNA, 26 bp, Artificial
  target sequence
gacagggctctattttataggcttct

SEQ ID NO: 293 - DNA, 19 bp, Artificial
  target sequence
gaaatacaatgtgtcaact

SEQ ID NO: 294 - DNA, 26 bp, Artificial
  target sequence
gacagggctctattttataggcttct

SEQ ID NO: 295 - DNA, 22 bp, Artificial
  target sequence
tcactatacaatgtgtcaagac

SEQ ID NO: 296 - DNA, 23 bp, Artificial
  target sequence
agggctctattttataggcttct

SEQ ID NO: 297 - DNA, 19 bp, Artificial
  target sequence
aaatacaatgtgtcaactc

SEQ ID NO: 298 - protein, 1368 aa, Unknown [sequence omitted]

SEQ ID NO: 299 - DNA, 26 bp, Artificial
  target sequence
gacagggctctattttataggcttct

SEQ ID NO: 300 - DNA, 20 bp, Artificial
  target sequence
ggctcactatgctgccgccc

SEQ ID NO: 301 - DNA, 25 bp, Artificial
  target sequence
aacagggctctattttataggcttc

SEQ ID NO: 302 - DNA, 45 bp, Artificial
  target sequence
atacaatgtgtcaactcttgacaaggctctattttataggcttct

SEQ ID NO: 303 - DNA, 20 bp, Artificial
  target sequence
cccagtgggactttggaaaa

SEQ ID NO: 304 - DNA, 25 bp, Artificial
  target sequence
acagggctctattttataggcttct

SEQ ID NO: 305 - DNA, 19 bp, Artificial
  target sequence
atacaatgtgtcaactcct

SEQ ID NO: 306 - DNA, 26 bp, Artificial
  target sequence
gacagggctctattttataggcttct

SEQ ID NO: 307 - DNA, 19 bp, Artificial
  target sequence
atacaatgtgtcaactctc

SEQ ID NO: 308 - DNA, 26 bp, Artificial
  target sequence
gacagggctctattttataggcttct

SEQ ID NO: 309 - DNA, 45 bp, Artificial; identical to SEQ ID NO: 279
  target sequence

SEQ ID NO: 310 - DNA, 45 bp, Artificial
  target sequence
gggtggtggctgtgtttgcgtctctcccaggaatcatctttacca

SEQ ID NO: 311 - DNA, 25 bp, Artificial
  target sequence
ttctgggctcactatgctgccgccc

SEQ ID NO: 312 - DNA, 20 bp, Artificial
  target sequence
cccaggaatcatctttacca

SEQ ID NO: 313 - DNA, 20 bp, Artificial
  target sequence
ggctcactatgctgccgccc

SEQ ID NO: 314 - DNA, 25 bp, Artificial
  target sequence
cccaggaatcatctttaccagatct

SEQ ID NO: 315 - DNA, 20 bp, Artificial
  target sequence
ggctcactatgctgccgccc

SEQ ID NO: 316 - DNA, 25 bp, Artificial
  target sequence
tcccaggaatcatctttaccagatc

SEQ ID NO: 317 - DNA, 25 bp, Artificial
  target sequence
tctgggctcactatgctgccgccct

SEQ ID NO: 318 - DNA, 20 bp, Artificial
  target sequence
cccaggaatcatctttacca

SEQ ID NO: 319 - DNA, 20 bp, Artificial
  target sequence
ggctcactatgctgccgccc

SEQ ID NO: 320 - DNA, 25 bp, Artificial
  target sequence
agagacgcaaacacagccaccaccc

SEQ ID NO: 321 - DNA, 25 bp, Artificial
  target sequence
cacattgtatttccaaagtcccact

SEQ ID NO: 322 - DNA, 20 bp, Artificial
  target sequence
cccaggaatcatctttacca

SEQ ID NO: 323 - DNA, 20 bp, Artificial
  target sequence
ggctcactatgctgccgccc

SEQ ID NO: 324 - DNA, 25 bp, Artificial
  target sequence
aatgtgtcaactcttgacagggctc

SEQ ID NO: 325 - DNA, 20 bp, Artificial
  target sequence
ggctcactatgctgccgccc

SEQ ID NO: 326 - DNA, 25 bp, Artificial
  target sequence
agagacgcaaacacagccaccaccc

SEQ ID NO: 327 - DNA, 25 bp, Artificial
  target sequence
acattgtatttccaaagtcccactt

SEQ ID NO: 328 - DNA, 20 bp, Artificial
  target sequence
cccaggaatcatctttacca

SEQ ID NO: 329 - DNA, 20 bp, Artificial
  target sequence
ggctcactatgctgccgccc

SEQ ID NO: 330 - DNA, 25 bp, Artificial
  target sequence
tagtgggactttggaaatacaatgt

SEQ ID NO: 331 - DNA, 25 bp, Artificial
  target sequence
ggtggtggctgtgtttgcgtctctt

SEQ ID NO: 332 - DNA, 20 bp, Artificial
  target sequence
cccaggaatcatctttacca

SEQ ID NO: 333 - DNA, 25 bp, Artificial
  target sequence
cttctgggctcactatgctgccgcc

SEQ ID NO: 334 - DNA, 20 bp, Artificial
  target sequence
cccaggaatcatctttacca

SEQ ID NO: 335 - DNA, 25 bp, Artificial
  target sequence
gctgtttcctgtgtgaaattgttat

SEQ ID NO: 336 - DNA, 20 bp, Artificial
  target sequence
cccaggaatcatctttacca

SEQ ID NO: 337 - DNA, 25 bp, Artificial
  target sequence
cccttctgggctcactatgctgccg

SEQ ID NO: 338 - DNA, 20 bp, Artificial
  target sequence
cccaggaatcatctttacca

SEQ ID NO: 339 - DNA, 20 bp, Artificial
  target sequence
ggctcactatgctgccgccc

SEQ ID NO: 340 - DNA, 25 bp, Artificial
  target sequence
aggaatcatctttaccagatctcaa

SEQ ID NO: 341 - DNA, 20 bp, Artificial
  target sequence
ggctcactatgctgccgccc

SEQ ID NO: 342 - DNA, 25 bp, Artificial
  target sequence
ccaggaatcatctttaccagatctc

SEQ ID NO: 343 - DNA, 20 bp, Artificial
  target sequence
ggctcactatgctgccgccc

SEQ ID NO: 344 - DNA, 25 bp, Artificial
  target sequence
ttactgtcgtccatgctgtgtttgc

SEQ ID NO: 345 - DNA, 24 bp, Artificial
  target sequence
ttctgggctcactatgctgccgcc

SEQ ID NO: 346 - DNA, 21 bp, Artificial
  target sequence
tcccaggaatcatctttacca

SEQ ID NO: 347 - DNA, 20 bp, Artificial
  target sequence
ggctcactatgctgccgccc

SEQ ID NO: 348 - DNA, 25 bp, Artificial
  target sequence
ttaccagatctcaaaaagaaggtct

SEQ ID NO: 349 - DNA, 20 bp, Artificial
  B2M gRNA target site sequence
ggctcactatgctgccgccc

SEQ ID NO: 350 - DNA, 25 bp, Artificial
  target sequence
tgtataccgtcgacctctagctaga

SEQ ID NO: 351 - DNA, 20 bp, Artificial
  target sequence
ggctcactatgctgccgccc

SEQ ID NO: 352 - DNA, 25 bp, Artificial
  target sequence
cagtgggactttggaaatacaatgt

SEQ ID NO: 353 - DNA, 20 bp, Artificial
  target sequence
ggctcactatgctgccgccc

SEQ ID NO: 354 - DNA, 25 bp, Artificial
  target sequence
tgggactttggaaatacaatgtgtc

SEQ ID NO: 355 - DNA, 20 bp, Artificial
  target sequence
ggctcactatgctgccgccc

SEQ ID NO: 356 - DNA, 25 bp, Artificial
  target sequence
aatacaatgtgtcaactcttgacag

SEQ ID NO: 357 - DNA, 20 bp, Artificial
  target sequence
ggctcactatgctgccgccc

SEQ ID NO: 358 - DNA, 25 bp, Artificial
  target sequence
tctcccaggaatcatctttaccaga

SEQ ID NO: 359 - DNA, 25 bp, Artificial
  target sequence
tgggctcactatgctgccgccctct

SEQ ID NO: 360 - DNA, 20 bp, Artificial
  target sequence
cccaggaatcatctttacca

SEQ ID NO: 361 - DNA, 25 bp, Artificial
  target sequence
tactgtccccttctgggctcactat

SEQ ID NO: 362 - DNA, 20 bp, Artificial
  target sequence
cccaggaatcatctttacca

SEQ ID NO: 363 - DNA, 25 bp, Artificial
  target sequence
tgggtggtggctgtgtttgcgtctt

SEQ ID NO: 364 - DNA, 20 bp, Artificial
  target sequence
cccaggaatcatctttacca

SEQ ID NO: 365 - DNA, 25 bp, Artificial
  target sequence
acttgggtggtggctgtgtttgcgt

SEQ ID NO: 366 - DNA, 20 bp, Artificial
  target sequence
cccaggaatcatctttacca

SEQ ID NO: 367 - DNA, 20 bp, Artificial
  target sequence
ggctcactatgctgccgccc

SEQ ID NO: 368 - DNA, 25 bp, Artificial
  target sequence
aagtgggactttggaaatacaatgt

SEQ ID NO: 369 - DNA, 20 bp, Artificial
  target sequence
ggctcactatgctgccgccc

SEQ ID NO: 370 - DNA, 25 bp, Artificial
  target sequence
gtgggactttggaaatacaatgtgt

SEQ ID NO: 371 - DNA, 20 bp, Artificial
  target sequence
ggctcactatgctgccgccc

SEQ ID NO: 372 - DNA, 25 bp, Artificial
  target sequence
tcttcatcatcctcctgacaatcga

SEQ ID NO: 373 - DNA, 20 bp, Artificial
  target sequence
ggctcactatgctgccgccc

SEQ ID NO: 374 - DNA, 25 bp, Artificial
  target sequence
ttataggcttcttctctggaatctt

SEQ ID NO: 375 - DNA, 25 bp, Artificial
  target sequence
ttcttcgatcagtctaaaaatggct

SEQ ID NO: 376 - DNA, 20 bp, Artificial
  target sequence
cccaggaatcatctttacca

SEQ ID NO: 377 - DNA, 20 bp, Artificial
  target sequence
ggctcactatgctgccgccc

SEQ ID NO: 378 - DNA, 25 bp, Artificial
  target sequence
catctttaccagatctcaaaaagaa

SEQ ID NO: 379 - DNA, 20 bp, Artificial
  target sequence
ggctcactatgctgccgccc

SEQ ID NO: 380 - DNA, 25 bp, Artificial
  target sequence
aataggcttcttctctggaatcttc

SEQ ID NO: 381 - DNA, 20 bp, Artificial
  target sequence
ggctcactatgctgccgccc

SEQ ID NO: 382 - DNA, 25 bp, Artificial
  target sequence
tttggggtggtgacaagtgtgatca

SEQ ID NO: 383 - DNA, 20 bp, Artificial
  target sequence
ggctcactatgctgccgccc

SEQ ID NO: 384 - DNA, 25 bp, Artificial
  target sequence
ttaaaagccaggacggtcacctttg

SEQ ID NO: 385 - DNA, 20 bp, Artificial
  target sequence
ggctcactatgctgccgccc

SEQ ID NO: 386 - DNA, 25 bp, Artificial
  target sequence
tgtttgcgtctctcccaggaatcat

SEQ ID NO: 387 - DNA, 25 bp, Artificial
  target sequence
agtgtgatcacttgggtggtggctg

SEQ ID NO: 388 - DNA, 20 bp, Artificial
  target sequence
cccaggaatcatctttacca

SEQ ID NO: 389 - DNA, 20 bp, Artificial
  target sequence
ggctcactatgctgccgccc

SEQ ID NO: 390 - DNA, 25 bp, Artificial
  target sequence
tctggaatcttcttcatcatcctcc

SEQ ID NO: 391 - DNA, 45 bp, Artificial
  target sequence
ggctcactatgctgccgccctgtgggactttggaaatacaatgtg

SEQ ID NO: 392 - DNA, 20 bp, Artificial
  target sequence
ggctcactatgctgccgccc

SEQ ID NO: 393 - DNA, 25 bp, Artificial
  target sequence
tttggaaatacaatgtgtcaactct

SEQ ID NO: 394 - DNA, 20 bp, Artificial
  target sequence
ggctcactatgctgccgccc

SEQ ID NO: 395 - DNA, 25 bp, Artificial
  target sequence
cccaagaatcatctttaccagatct

SEQ ID NO: 396 - DNA, 25 bp, Artificial
  target sequence
ccttctgggctcactatgctgccgc

SEQ ID NO: 397 - DNA, 20 bp, Artificial
  target sequence
cccaggaatcatctttacca

SEQ ID NO: 398 - DNA, 25 bp, Artificial
  target sequence
tgggtggtggctgtgtttgcgtctc

SEQ ID NO: 399 - DNA, 20 bp, Artificial
  target sequence
cccaggaatcatctttacca

SEQ ID NO: 400 - DNA, 20 bp, Artificial
  target sequence
ggctcactatgctgccgccc

SEQ ID NO: 401 - DNA, 25 bp, Artificial
  target sequence
acaatgtgtcaactcttgacagggc

SEQ ID NO: 402 - DNA, 20 bp, Artificial
  target sequence
ggctcactatgctgccgccc

SEQ ID NO: 403 - DNA, 25 bp, Artificial
  target sequence
gtgggactttggaaattcaatgtgt

SEQ ID NO: 404 - DNA, 20 bp, Artificial
  target sequence
ggctcactatgctgccgccc

SEQ ID NO: 405 - DNA, 25 bp, Artificial
  target sequence
gcccaggaatcatctttaccagatc

SEQ ID NO: 406 - DNA, 20 bp, Artificial
  target sequence
ggctcactatgctgccgccc

SEQ ID NO: 407 - DNA, 25 bp, Artificial
  target sequence
ggctgtgtttgcgtctctccaggaa

SEQ ID NO: 408 - DNA, 25 bp, Artificial
  target sequence
tcttactgtccccttctgcgtctct

SEQ ID NO: 409 - DNA, 20 bp, Artificial
  target sequence
cccaggaatcatctttacca

SEQ ID NO: 410 - DNA, 25 bp, Artificial
  target sequence
ggtggtggctgtgtttgcgtctctc

SEQ ID NO: 411 - DNA, 20 bp, Artificial
  target sequence
cccaggaatcatctttacca

SEQ ID NO: 412 - DNA, 23 bp, Artificial
  target sequence
ccaggaatcatctttactaaatg

SEQ ID NO: 413 - DNA, 23 bp, Artificial
  target sequence
ccaggcatcttctttaccagctc

SEQ ID NO: 414 - DNA, 23 bp, Artificial
  target sequence
aaaatgtgtcaactcttgattag

SEQ ID NO: 415 - DNA, 23 bp, Artificial
  target sequence
aaaatgtgtcaactcttgattag

SEQ ID NO: 416 - DNA, 23 bp, Artificial
  target sequence
cccactgggctgcagaatacaga

SEQ ID NO: 417 - DNA, 23 bp, Artificial
  target sequence
tctgtgtttgcctctctctcagg

SEQ ID NO: 418 - DNA, 23 bp, Artificial
  target sequence
cccgggagggaggcaaaaacagc

SEQ ID NO: 419 - DNA, 27 bp, Artificial
  B2M gRNA target site sequence
tttaatataagtggaggcgtcgcgctg

SEQ ID NO: 420 - DNA, 27 bp, Artificial
  B2M gRNA target site sequence
tttctggcctggaggctatccagcgtg

SEQ ID NO: 421 - DNA, 27 bp, Artificial
  B2M gRNA target site sequence
tttcggcggggagcaggggagaccttt

SEQ ID NO: 422 - DNA, 27 bp, Artificial
  B2M gRNA target site sequence
tttggcctacggcgacgggagggtcgg

SEQ ID NO: 423 - DNA, 27 bp, Artificial
  B2M gRNA target site sequence
tttgtcccgaccctcccgtcgccgtag

SEQ ID NO: 424 - DNA, 27 bp, Artificial
  B2M gRNA target site sequence
tttagggcgtcgataagcgtcagagcg

SEQ ID NO: 425 - DNA, 27 bp, Artificial
  B2M gRNA target site sequence
tttctcttccgctctttcgcggggcct

SEQ ID NO: 426 - DNA, 27 bp, Artificial
  B2M gRNA target site sequence
tttcgcggggcctctggctcccccagc

SEQ ID NO: 427 - DNA, 27 bp, Artificial
  B2M gRNA target site sequence
tttgggacgagcctacccgtcccccac

SEQ ID NO: 428 - DNA, 27 bp, Artificial
  B2M gRNA target site sequence
tttgtgaacgcgtggaggggcgcttgg

SEQ ID NO: 429 - DNA, 27 bp, Artificial
  B2M gRNA target site sequence
tttcctccccacggtgtggccccacat

SEQ ID NO: 430 - DNA, 27 bp, Artificial
  B2M gRNA target site sequence
tttgtagaatgcttggctgtgatacaa

SEQ ID NO: 431 - DNA, 27 bp, Artificial
  B2M gRNA target site sequence
tttgtatcacagccaagcattctacaa

SEQ ID NO: 432 - DNA, 27 bp, Artificial
  B2M gRNA target site sequence
tttcgaataattaacttatttgttccc

SEQ ID NO: 433 - DNA, 27 bp, Artificial
  B2M gRNA target site sequence
tttgttcccatcacatgtcacttttaa

SEQ ID NO: 434 - DNA, 27 bp, Artificial
  B2M gRNA target site sequence
tttaaaagtgacatgtgatgggaacaa

SEQ ID NO: 435 - DNA, 27 bp, Artificial
  B2M gRNA target site sequence
ttttaaaagtgacatgtgatgggaaca

SEQ ID NO: 436 - DNA, 27 bp, Artificial
  B2M gRNA target site sequence
tttttaaaagtgacatgtgatgggaac

SEQ ID NO: 437 - DNA, 27 bp, Artificial
  B2M gRNA target site sequence
ttttttaaaagtgacatgtgatgggaa

SEQ ID NO: 438 - DNA, 27 bp, Artificial
  B2M gRNA target site sequence
ttttaaaaaattataagaactacccgt

SEQ ID NO: 439 - DNA, 27 bp, Artificial
  B2M gRNA target site sequence
tttaaaaaattataagaactacccgtt

SEQ ID NO: 440 - DNA, 27 bp, Artificial
  B2M gRNA target site sequence
tttctgtgtgccaaggactttatgtgc

SEQ ID NO: 441 - DNA, 27 bp, Artificial
  B2M gRNA target site sequence
tttatgtgctttgcgtcatttaatttt

SEQ ID NO: 442 - DNA, 27 bp, Artificial
  B2M gRNA target site sequence
tttcaaaattaaatgacgcaaagcaca

SEQ ID NO: 443 - DNA, 27 bp, Artificial
  B2M gRNA target site sequence
ttttcaaaattaaatgacgcaaagcac

SEQ ID NO: 444 - DNA, 27 bp, Artificial
  B2M gRNA target site sequence
tttgcgtcatttaattttgaaaacagt

SEQ ID NO: 445 - DNA, 27 bp, Artificial
  B2M gRNA target site sequence
tttaattttgaaaacagttatcttccg

SEQ ID NO: 446 - DNA, 27 bp, Artificial
  B2M gRNA target site sequence
ttttgaaaacagttatcttccgccata

SEQ ID NO: 447 - DNA, 27 bp, Artificial
  B2M gRNA target site sequence
tttgaaaacagttatcttccgccatag

SEQ ID NO: 448 - DNA, 27 bp, Artificial
  B2M gRNA target site sequence
tttcttcatctgtgagaggcagaagat

SEQ ID NO: 449 - DNA, 27 bp, Artificial
  B2M gRNA target site sequence
tttcttaaaatctcggtgccttagttt

SEQ ID NO: 450 - DNA, 27 bp, Artificial
  B2M gRNA target site sequence
ttttaagaaacttaattacacagggga

SEQ ID NO: 451 - DNA, 27 bp, Artificial
  B2M gRNA target site sequence
tttaagaaacttaattacacaggggat

SEQ ID NO: 452 - DNA, 27 bp, Artificial
  B2M gRNA target site sequence
tttatcccctgtgtaattaagtttctt

SEQ ID NO: 453 - DNA, 27 bp, Artificial
  B2M gRNA target site sequence
ttttgcgggagcgcatgccttttggct

SEQ ID NO: 454 - DNA, 27 bp, Artificial
  B2M gRNA target site sequence
tttgcgggagcgcatgccttttggctg

SEQ ID NO: 455 - DNA, 27 bp, Artificial
  B2M gRNA target site sequence
ttttggctgtaattcgtgcattttttt

SEQ ID NO: 456 - DNA, 27 bp, Artificial
  B2M gRNA target site sequence
tttggctgtaattcgtgcatttttttt

SEQ ID NO: 457 - DNA, 27 bp, Artificial
  B2M gRNA target site sequence
tttcttaaaaaaaaatgcacgaattac

SEQ ID NO: 458 - DNA, 27 bp, Artificial
  B2M gRNA target site sequence
ttttcttaaaaaaaaatgcacgaatta

SEQ ID NO: 459 - DNA, 27 bp, Artificial
  B2M gRNA target site sequence
tttttcttaaaaaaaaatgcacgaatt

SEQ ID NO: 460 - DNA, 27 bp, Artificial
  B2M gRNA target site sequence
tttttttttaagaaaaacgcctgcctt

SEQ ID NO: 461 - DNA, 27 bp, Artificial
  B2M gRNA target site sequence
ttttttttaagaaaaacgcctgccttc

SEQ ID NO: 462 - DNA, 27 bp, Artificial
  B2M gRNA target site sequence
tttttttaagaaaaacgcctgccttct

SEQ ID NO: 463 - DNA, 27 bp, Artificial
  B2M gRNA target site sequence
ttttttaagaaaaacgcctgccttctg

SEQ ID NO: 464 - DNA, 27 bp, Artificial
  B2M gRNA target site sequence
tttttaagaaaaacgcctgccttctgc

SEQ ID NO: 465 - DNA, 27 bp, Artificial
  B2M gRNA target site sequence
ttttaagaaaaacgcctgccttctgcg

SEQ ID NO: 466 - DNA, 27 bp, Artificial
  B2M gRNA target site sequence
tttaagaaaaacgcctgccttctgcgt

SEQ ID NO: 467 - DNA, 27 bp, Artificial
  B2M gRNA target site sequence
tttgctctggagaatctcacgcagaag

SEQ ID NO: 468 - DNA, 27 bp, Artificial
  B2M gRNA target site sequence
ttttcgtacagagggcttcctctttgg

SEQ ID NO: 469 - DNA, 27 bp, Artificial
  B2M gRNA target site sequence
tttcgtacagagggcttcctctttggc

SEQ ID NO: 470 - DNA, 27 bp, Artificial
  B2M gRNA target site sequence
tttggctctttgcctggttgtttccaa

SEQ ID NO: 471 - DNA, 27 bp, Artificial
  B2M gRNA target site sequence
tttgcctggttgtttccaagatgtact

SEQ ID NO: 472 - DNA, 27 bp, Artificial
  B2M gRNA target site sequence
tttccaagatgtactgtgcctcttact

SEQ ID NO: 473 - DNA, 27 bp, Artificial
  B2M gRNA target site sequence
tttcaaaaccgaaagtaagaggcacag

SEQ ID NO: 474 - DNA, 27 bp, Artificial
  B2M gRNA target site sequence
ttttcaaaaccgaaagtaagaggcaca

SEQ ID NO: 475 - DNA, 27 bp, Artificial
  B2M gRNA target site sequence
tttcggttttgaaaacatgagggggtt

SEQ ID NO: 476 - DNA, 27 bp, Artificial
  B2M gRNA target site sequence
ttttgaaaacatgagggggttgggcgt

SEQ ID NO: 477 - DNA, 27 bp, Artificial
  B2M gRNA target site sequence
tttgaaaacatgagggggttgggcgtg

SEQ ID NO: 478 - DNA, 27 bp, Artificial
  B2M gRNA target site sequence
tttgtagagaccaggcttcaccatgtt

SEQ ID NO: 479 - DNA, 27 bp, Artificial
  B2M gRNA target site sequence
ttttgtagagaccaggcttcaccatgt

SEQ ID NO: 480 - DNA, 27 bp, Artificial
  B2M gRNA target site sequence
tttttgtagagaccaggcttcaccatg

SEQ ID NO: 481 - DNA, 27 bp, Artificial
  B2M gRNA target site sequence
ttttttgtagagaccaggcttcaccat

SEQ ID NO: 482 - DNA, 27 bp, Artificial
  B2M gRNA target site sequence
tttgttattattttttgtagagaccag

SEQ ID NO: 483 - DNA, 27 bp, Artificial
  B2M gRNA target site sequence
ttttgttattattttttgtagagacca

SEQ ID NO: 484 - DNA, 27 bp, Artificial
  B2M gRNA target site sequence
tttttgttattattttttgtagagacc

SEQ ID NO: 485 - DNA, 27 bp, Artificial
  B2M gRNA target site sequence
ttttgagctatcatggcgccagtgcac

SEQ ID NO: 486 - DNA, 27 bp, Artificial
  B2M gRNA target site sequence
tttgagctatcatggcgccagtgcact

SEQ ID NO: 487 - DNA, 27 bp, Artificial
  B2M gRNA target site sequence
tttgagagacagggtctcgctctgttg

SEQ ID NO: 488 - DNA, 27 bp, Artificial
  B2M gRNA target site sequence
ttttgagagacagggtctcgctctgtt

SEQ ID NO: 489 - DNA, 27 bp, Artificial
  B2M gRNA target site sequence
tttttgagagacagggtctcgctctgt

SEQ ID NO: 490 - DNA, 27 bp, Artificial
  B2M gRNA target site sequence
ttttttgagagacagggtctcgctctg

SEQ ID NO: 491 - DNA, 27 bp, Artificial
  B2M gRNA target site sequence
tttcttttttgagagacagggtctcgc

SEQ ID NO: 492 - DNA, 27 bp, Artificial
  B2M gRNA target site sequence
ttttcttttttgagagacagggtctcg

SEQ ID NO: 493 - DNA, 27 bp, Artificial
  B2M gRNA target site sequence
tttttcttttttgagagacagggtctc

SEQ ID NO: 494 - DNA, 27 bp, Artificial
  B2M gRNA target site sequence
ttttttcttttttgagagacagggtct

SEQ ID NO: 495 - DNA, 27 bp, Artificial
  B2M gRNA target site sequence
tttttttcttttttgagagacagggtc

SEQ ID NO: 496 - DNA, 27 bp, Artificial
  B2M gRNA target site sequence
ttttttttcttttttgagagacagggt

SEQ ID NO: 497 - DNA, 27 bp, Artificial
  B2M gRNA target site sequence
tttttttttcttttttgagagacaggg

SEQ ID NO: 498 - DNA, 27 bp, Artificial
  B2M gRNA target site sequence
ttttttttttcttttttgagagacagg

SEQ ID NO: 499 - DNA, 27 bp, Artificial
  B2M gRNA target site sequence
tttttttttttcttttttgagagacag

SEQ ID NO: 500 - DNA, 27 bp, Artificial
  B2M gRNA target site sequence
ttttttttttttcttttttgagagaca

SEQ ID NO: 501 - DNA, 27 bp, Artificial
  B2M gRNA target site sequence
tttttttttttttcttttttgagagac

SEQ ID NO: 502 - DNA, 27 bp, Artificial
  B2M gRNA target site sequence
ttttttttttttttcttttttgagaga

SEQ ID NO: 503 - DNA, 27 bp, Artificial
  B2M gRNA target site sequence
tttttttttttttttcttttttgagag

SEQ ID NO: 504 - DNA, 27 bp, Artificial
  B2M gRNA target site sequence
tttctttttttttttttttcttttttg

SEQ ID NO: 505 - DNA, 27 bp, Artificial
  B2M gRNA target site sequence
tttctctttctttttttttttttttct

SEQ ID NO: 506 - DNA, 27 bp, Artificial
  B2M gRNA target site sequence
ttttctctttctttttttttttttttc

SEQ ID NO: 507 - DNA, 27 bp, Artificial
  B2M gRNA target site sequence
tttcttttctctttctttttttttttt

SEQ ID NO: 508 - DNA, 27 bp, Artificial
  B2M gRNA target site sequence
ttttcttttctctttcttttttttttt

SEQ ID NO: 509 - DNA, 27 bp, Artificial
  B2M gRNA target site sequence
tttcttttcttttctctttcttttttt

SEQ ID NO: 510 - DNA, 27 bp, Artificial
  B2M gRNA target site sequence
tttctttcttttcttttctctttcttt

SEQ ID NO: 511 - DNA, 27 bp, Artificial
  B2M gRNA target site sequence
tttacagctcccctgactgacaaacct

SEQ ID NO: 512 - DNA, 27 bp, Artificial
  B2M gRNA target site sequence
ttttacagctcccctgactgacaaacc

SEQ ID NO: 513 - DNA, 27 bp, Artificial
  B2M gRNA target site sequence
tttgtcagtcaggggagctgtaaaacc

SEQ ID NO: 514 - DNA, 27 bp, Artificial
  B2M gRNA target site sequence
tttattaatggttttacagctcccctg

SEQ ID NO: 515 - DNA, 27 bp, Artificial
  B2M gRNA target site sequence
tttctaagtacctggcaatacactaag

SEQ ID NO: 516 - DNA, 27 bp, Artificial
  B2M gRNA target site sequence
tttgccagaggaaaaggtgagcgcgct

SEQ ID NO: 517 - DNA, 27 bp, Artificial
  B2M gRNA target site sequence
ttttgccagaggaaaaggtgagcgcgc

SEQ ID NO: 518 - DNA, 27 bp, Artificial
  B2M gRNA target site sequence
ttttcctctggcaaaacatgatcgaaa

SEQ ID NO: 519 - DNA, 27 bp, Artificial
  B2M gRNA target site sequence
tttcgatcatgttttgccagaggaaaa

SEQ ID NO: 520 - DNA, 27 bp, Artificial
  B2M gRNA target site sequence
tttcctctggcaaaacatgatcgaaag

SEQ ID NO: 521 - DNA, 27 bp, Artificial
  B2M gRNA target site sequence
tttctcatgatcaaaacattctgcttt

SEQ ID NO: 522 - DNA, 27 bp, Artificial
  B2M gRNA target site sequence
ttttctcatgatcaaaacattctgctt

SEQ ID NO: 523 - DNA, 27 bp, Artificial
  B2M gRNA target site sequence
ttttgatcatgagaaaattgcatttaa

SEQ ID NO: 524 - DNA, 27 bp, Artificial
  B2M gRNA target site sequence
tttgatcatgagaaaattgcatttaat

SEQ ID NO: 525 - DNA, 27 bp, Artificial
  B2M gRNA target site sequence
tttaatttgaatacaatttatttacaa

SEQ ID NO: 526 - DNA, 27 bp, Artificial
  B2M gRNA target site sequence
tttgaatacaatttatttacaacataa

SEQ ID NO: 527 - DNA, 27 bp, Artificial
  B2M gRNA target site sequence
tttatgttgtaaataaattgtattcaa

SEQ ID NO: 528 - DNA, 27 bp, Artificial
  B2M gRNA target site sequence
tttatttacaacataaaggataatgta

SEQ ID NO: 529 - DNA, 27 bp, Artificial
  B2M gRNA target site sequence
tttacaacataaaggataatgtatata

SEQ ID NO: 530 - DNA, 27 bp, Artificial
  B2M gRNA target site sequence
tttgctggttatgttagatgtcatttt

SEQ ID NO: 531 - DNA, 27 bp, Artificial
  B2M gRNA target site sequence
tttaaaatgacatctaacataaccagc

SEQ ID NO: 532 - DNA, 27 bp, Artificial
  B2M gRNA target site sequence
ttttaaaatgacatctaacataaccag

SEQ ID NO: 533 - DNA, 27 bp, Artificial
  B2M gRNA target site sequence
tttttaaaatgacatctaacataacca

SEQ ID NO: 534 - DNA, 27 bp, Artificial
  B2M gRNA target site sequence
ttttttaaaatgacatctaacataacc

SEQ ID NO: 535 - DNA, 27 bp, Artificial
  B2M gRNA target site sequence
ttttaaaaaataacaatctgatattta

SEQ ID NO: 536 - DNA, 27 bp, Artificial
  B2M gRNA target site sequence
tttaaaaaataacaatctgatatttaa

SEQ ID NO: 537 - DNA, 27 bp, Artificial
  B2M gRNA target site sequence
tttaaatatcagattgttattttttaa

SEQ ID NO: 538 - DNA, 27 bp, Artificial
  B2M gRNA target site sequence
ttttaaatatcagattgttatttttta

SEQ ID NO: 539 - DNA, 27 bp, Artificial
  B2M gRNA target site sequence
tttttaaatatcagattgttatttttt

SEQ ID NO: 540 - DNA, 27 bp, Artificial
  B2M gRNA target site sequence
ttttttaaatatcagattgttattttt

SEQ ID NO: 541 - DNA, 27 bp, Artificial
  B2M gRNA target site sequence
tttttttaaatatcagattgttatttt

SEQ ID NO: 542 - DNA, 27 bp, Artificial
  B2M gRNA target site sequence
ttttttttaaatatcagattgttattt

SEQ ID NO: 543 - DNA, 27 bp, Artificial
  B2M gRNA target site sequence
tttttttttaaatatcagattgttatt

SEQ ID NO: 544 - DNA, 27 bp, Artificial
  B2M gRNA target site sequence
tttcaaaataagatttttttttaaata

SEQ ID NO: 545 - DNA, 27 bp, Artificial
  B2M gRNA target site sequence
ttttcaaaataagatttttttttaaat

SEQ ID NO: 546 - DNA, 27 bp, Artificial
  B2M gRNA target site sequence
tttaaaaaaaaatcttattttgaaaat

SEQ ID NO: 547 - DNA, 27 bp, Artificial
  B2M gRNA target site sequence
tttggaaattttcaaaataagattttt

SEQ ID NO: 548 - DNA, 27 bp, Artificial
  B2M gRNA target site sequence
ttttgaaaatttccaaagtaatacatg

SEQ ID NO: 549 - DNA, 27 bp, Artificial
  B2M gRNA target site sequence
tttgaaaatttccaaagtaatacatgc

SEQ ID NO: 550 - DNA, 27 bp, Artificial
  B2M gRNA target site sequence
tttccaaagtaatacatgccatgcata

SEQ ID NO: 551 - DNA, 27 bp, Artificial
  B2M gRNA target site sequence
tttcttgtggtatcttccagaaatggt

SEQ ID NO: 552 - DNA, 27 bp, Artificial
  B2M gRNA target site sequence
tttctggaagataccacaagaaacatg

SEQ ID NO: 553 - DNA, 27 bp, Artificial
  B2M gRNA target site sequence
ttttcctcctctgacctgtgtgtgggt

SEQ ID NO: 554 - DNA, 27 bp, Artificial
  B2M gRNA target site sequence
tttcctcctctgacctgtgtgtgggtt

SEQ ID NO: 555 - DNA, 27 bp, Artificial
  B2M gRNA target site sequence
ttttgtttttgttttactgtgggcata

SEQ ID NO: 556 - DNA, 27 bp, Artificial
  B2M gRNA target site sequence
tttgtttttgttttactgtgggcataa

SEQ ID NO: 557 - DNA, 27 bp, Artificial
  B2M gRNA target site sequence
tttatgcccacagtaaaacaaaaacaa

SEQ ID NO: 558 - DNA, 27 bp, Artificial
  B2M gRNA target site sequence
tttttgttttactgtgggcataaatta

SEQ ID NO: 559 - DNA, 27 bp, Artificial
  B2M gRNA target site sequence
ttttgttttactgtgggcataaattaa

SEQ ID NO: 560 - DNA, 27 bp, Artificial
  B2M gRNA target site sequence
tttgttttactgtgggcataaattaat

SEQ ID NO: 561 - DNA, 27 bp, Artificial
  B2M gRNA target site sequence
ttttactgtgggcataaattaattttt

SEQ ID NO: 562 - DNA, 27 bp, Artificial
  B2M gRNA target site sequence
tttactgtgggcataaattaatttttc

SEQ ID NO: 563 - DNA, 27 bp, Artificial
  B2M gRNA target site sequence
tttttcagttaagttttggaagcttaa

SEQ ID NO: 564 - DNA, 27 bp, Artificial
  B2M gRNA target site sequence
ttttcagttaagttttggaagcttaaa

SEQ ID NO: 565 - DNA, 27 bp, Artificial
  B2M gRNA target site sequence
tttaagcttccaaaacttaactgaaaa

SEQ ID NO: 566 - DNA, 27 bp, Artificial
  B2M gRNA target site sequence
tttcagttaagttttggaagcttaaat

SEQ ID NO: 567 - DNA, 27 bp, Artificial
  B2M gRNA target site sequence
ttttggaagcttaaataactctccaaa

SEQ ID NO: 568 - DNA, 27 bp, Artificial
  B2M gRNA target site sequence
tttggagagttatttaagcttccaaaa

SEQ ID NO: 569 - DNA, 27 bp, Artificial
  B2M gRNA target site sequence
tttggaagcttaaataactctccaaaa

SEQ ID NO: 570 - DNA, 27 bp, Artificial
  B2M gRNA target site sequence
ttttggagagttatttaagcttccaaa

SEQ ID NO: 571 - DNA, 27 bp, Artificial
  B2M gRNA target site sequence
tttatgacttttggagagttatttaag

SEQ ID NO: 572 - DNA, 27 bp, Artificial
  B2M gRNA target site sequence
tttgggctcaaccagttactggcttta

SEQ ID NO: 573 - DNA, 27 bp, Artificial
  B2M gRNA target site sequence
tttgaatttgggctcaaccagttactg

SEQ ID NO: 574 - DNA, 27 bp, Artificial
  B2M gRNA target site sequence
tttctaagaagaggacaagtatcagac

SEQ ID NO: 575 - DNA, 27 bp, Artificial
  B2M gRNA target site sequence
ttttctaagaagaggacaagtatcaga

SEQ ID NO: 576 - DNA, 27 bp, Artificial
  B2M gRNA target site sequence
tttgtgagagcatcactgtaatctttt

SEQ ID NO: 577 - DNA, 27 bp, Artificial
  B2M gRNA target site sequence
ttttgtgagagcatcactgtaatcttt

SEQ ID NO: 578 - DNA, 27 bp, Artificial
  B2M gRNA target site sequence
tttgagggaaggcggcaagattttgtg

SEQ ID NO: 579 - DNA, 27 bp, Artificial
  B2M gRNA target site sequence
tttaatatgttcttattattagaagct

SEQ ID NO: 580 - DNA, 27 bp, Artificial
  B2M gRNA target site sequence
tttgcatctgagcttctaataataaga

SEQ ID NO: 581 - DNA, 27 bp, Artificial
  B2M gRNA target site sequence
tttcataacattaaaagctaagagagc

SEQ ID NO: 582 - DNA, 27 bp, Artificial
  B2M gRNA target site sequence
ttttcataacattaaaagctaagagag

SEQ ID NO: 583 - DNA, 27 bp, Artificial
  B2M gRNA target site sequence
tttttcataacattaaaagctaagaga

SEQ ID NO: 584 - DNA, 27 bp, Artificial
  B2M gRNA target site sequence
ttttttcataacattaaaagctaagag

SEQ ID NO: 585 - DNA, 27 bp, Artificial
  B2M gRNA target site sequence
tttttttcataacattaaaagctaaga

SEQ ID NO: 586 - DNA, 27 bp, Artificial
  B2M gRNA target site sequence
ttttaatgttatgaaaaaaatcaggtc

SEQ ID NO: 587 - DNA, 27 bp, Artificial
  B2M gRNA target site sequence
tttaatgttatgaaaaaaatcaggtct

SEQ ID NO: 588 - DNA, 27 bp, Artificial
  B2M gRNA target site sequence
tttccttaatgatagggtgtttctaga

SEQ ID NO: 589 - DNA, 27 bp, Artificial
  B2M gRNA target site sequence
tttctagagagatatatctggtcaagg

SEQ ID NO: 590 - DNA, 27 bp, Artificial
  B2M gRNA target site sequence
ttttagtgatcatgtaccctgaatata

SEQ ID NO: 591 - DNA, 27 bp, Artificial
  B2M gRNA target site sequence
tttagtgatcatgtaccctgaatataa

SEQ ID NO: 592 - DNA, 27 bp, Artificial
  B2M gRNA target site sequence
tttaaatacacttatattcagggtaca

SEQ ID NO: 593 - DNA, 27 bp, Artificial
  B2M gRNA target site sequence
ttttaaatacacttatattcagggtac

SEQ ID NO: 594 - DNA, 27 bp, Artificial
  B2M gRNA target site sequence
tttaaaagaattttatacacatatatt

SEQ ID NO: 595 - DNA, 27 bp, Artificial
  B2M gRNA target site sequence
ttttatacacatatatttagtgtcaat

SEQ ID NO: 596 - DNA, 27 bp, Artificial
  B2M gRNA target site sequence
tttatacacatatatttagtgtcaatc

SEQ ID NO: 597 - DNA, 27 bp, Artificial
  B2M gRNA target site sequence
tttagtgtcaatctgtatatttagtag

SEQ ID NO: 598 - DNA, 27 bp, Artificial
  B2M gRNA target site sequence
tttagtagcactaacacttctcttcat

SEQ ID NO: 599 - DNA, 27 bp, Artificial
  B2M gRNA target site sequence
tttcattgaaaatgaagagaagtgtta

SEQ ID NO: 600 - DNA, 27 bp, Artificial
  B2M gRNA target site sequence
ttttcattgaaaatgaagagaagtgtt

SEQ ID NO: 601 - DNA, 27 bp, Artificial
  B2M gRNA target site sequence
tttttcattgaaaatgaagagaagtgt

SEQ ID NO: 602 - DNA, 27 bp, Artificial
  B2M gRNA target site sequence
ttttcaatgaaaaatatagagtttata

SEQ ID NO: 603 - DNA, 27 bp, Artificial
  B2M gRNA target site sequence
tttcaatgaaaaatatagagtttataa

SEQ ID NO: 604 - DNA, 27 bp, Artificial
  B2M gRNA target site sequence
tttataatattttcttcccacttcccc

SEQ ID NO: 605 - DNA, 27 bp, Artificial
  B2M gRNA target site sequence
ttttcttcccacttccccatggatggt

SEQ ID NO: 606 - DNA, 27 bp, Artificial
  B2M gRNA target site sequence
tttcttcccacttccccatggatggtc

SEQ ID NO: 607 - DNA, 27 bp, Artificial
  B2M gRNA target site sequence
tttccaaaatgagaggcatgactagac

SEQ ID NO: 608 - DNA, 27 bp, Artificial
  B2M gRNA target site sequence
tttcagaaacagtactttccaaaatga

SEQ ID NO: 609 - DNA, 27 bp, Artificial
  B2M gRNA target site sequence
ttttggaaagtactgtttctgaaacat

SEQ ID NO: 610 - DNA, 27 bp, Artificial
  B2M gRNA target site sequence
tttggaaagtactgtttctgaaacatt

SEQ ID NO: 611 - DNA, 27 bp, Artificial
  B2M gRNA target site sequence
tttctgaaacattaggcaatatattcc

SEQ ID NO: 612 - DNA, 27 bp, Artificial
  B2M gRNA target site sequence
tttacagcaatcacctgtggatgctaa

SEQ ID NO: 613 - DNA, 27 bp, Artificial
  B2M gRNA target site sequence
tttaattagcatccacaggtgattgct

SEQ ID NO: 614 - DNA, 27 bp, Artificial
  B2M gRNA target site sequence
ttttaattagcatccacaggtgattgc

SEQ ID NO: 615 - DNA, 27 bp, Artificial
  B2M gRNA target site sequence
tttgcgttttaattagcatccacaggt

SEQ ID NO: 616 - DNA, 27 bp, Artificial
  B2M gRNA target site sequence
tttccattatgatcaaatggagtaatg

SEQ ID NO: 617 - DNA, 27 bp, Artificial
  B2M gRNA target site sequence
tttgatcataatggaaagtatgttctg

SEQ ID NO: 618 - DNA, 27 bp, Artificial
  B2M gRNA target site sequence
tttgccatagtcctcacctatccctgt

SEQ ID NO: 619 - DNA, 27 bp, Artificial
  B2M gRNA target site sequence
ttttatcgggtccaactcaaccattta

SEQ ID NO: 620 - DNA, 27 bp, Artificial
  B2M gRNA target site sequence
tttatcgggtccaactcaaccatttaa

SEQ ID NO: 621 - DNA, 27 bp, Artificial
  B2M gRNA target site sequence
tttaaggtatttgccagctcttgtatg

SEQ ID NO: 622 - DNA, 27 bp, Artificial
  B2M gRNA target site sequence
tttgccagctcttgtatgcatttaggt

SEQ ID NO: 623 - DNA, 27 bp, Artificial
  B2M gRNA target site sequence
tttaggttttgtttctttgttttttag

SEQ ID NO: 624 - DNA, 27 bp, Artificial
  B2M gRNA target site sequence
ttttgtttctttgttttttagctcatg

SEQ ID NO: 625 - DNA, 27 bp, Artificial
  B2M gRNA target site sequence
tttgtttctttgttttttagctcatga

SEQ ID NO: 626 - DNA, 27 bp, Artificial
  B2M gRNA target site sequence
tttcatgagctaaaaaacaaagaaaca

SEQ ID NO: 627 - DNA, 27 bp, Artificial
  B2M gRNA target site sequence
tttctttgttttttagctcatgaaatt

SEQ ID NO: 628 - DNA, 27 bp, Artificial
  B2M gRNA target site sequence
tttgttttttagctcatgaaattaggt

SEQ ID NO: 629 - DNA, 27 bp, Artificial
  B2M gRNA target site sequence
ttttttagctcatgaaattaggtacaa

SEQ ID NO: 630 - DNA, 27 bp, Artificial
  B2M gRNA target site sequence
tttttagctcatgaaattaggtacaaa

SEQ ID NO: 631 - DNA, 27 bp, Artificial
  B2M gRNA target site sequence
tttgtacctaatttcatgagctaaaaa

SEQ ID NO: 632 - DNA, 27 bp, Artificial
  B2M gRNA target site sequence
ttttagctcatgaaattaggtacaaag

SEQ ID NO: 633 - DNA, 27 bp, Artificial
  B2M gRNA target site sequence
tttagctcatgaaattaggtacaaagt

SEQ ID NO: 634 - DNA, 27 bp, Artificial
  B2M gRNA target site sequence
tttatatgccagacccctctctgactt

SEQ ID NO: 635 - DNA, 27 bp, Artificial
  B2M gRNA target site sequence
ttttatatgccagacccctctctgact

SEQ ID NO: 636 - DNA, 27 bp, Artificial
  B2M gRNA target site sequence
tttctgctgaggttttatatgccagac

SEQ ID NO: 637 - DNA, 27 bp, Artificial
  B2M gRNA target site sequence
tttatttctgctgaggttttatatgcc

SEQ ID NO: 638 - DNA, 27 bp, Artificial
  B2M gRNA target site sequence
ttttgttgtttggtaagaacatacctt

SEQ ID NO: 639 - DNA, 27 bp, Artificial
  B2M gRNA target site sequence
tttgttgtttggtaagaacataccttg

SEQ ID NO: 640 - DNA, 27 bp, Artificial
  B2M gRNA target site sequence
tttggtaagaacataccttgggttggt

SEQ ID NO: 641 - DNA, 27 bp, Artificial
  B2M gRNA target site sequence
tttgggaggccaaggcaggctgatcac

SEQ ID NO: 642 - DNA, 27 bp, Artificial
  B2M gRNA target site sequence
tttcaccatgttggccaggctggtctt

SEQ ID NO: 643 - DNA, 27 bp, Artificial
  B2M gRNA target site sequence
tttcagtagagacgggatttcaccatg

SEQ ID NO: 644 - DNA, 27 bp, Artificial
  B2M gRNA target site sequence
ttttcagtagagacgggatttcaccat

SEQ ID NO: 645 - DNA, 27 bp, Artificial
  B2M gRNA target site sequence
tttgtattttcagtagagacgggattt

SEQ ID NO: 646 - DNA, 27 bp, Artificial
  B2M gRNA target site sequence
ttttgtattttcagtagagacgggatt

SEQ ID NO: 647 - DNA, 27 bp, Artificial
  B2M gRNA target site sequence
tttttgtattttcagtagagacgggat

SEQ ID NO: 648 - DNA, 27 bp, Artificial
  B2M gRNA target site sequence
tttgggatggaatctcattccattgcc

SEQ ID NO: 649 - DNA, 27 bp, Artificial
  B2M gRNA target site sequence
ttttgggatggaatctcattccattgc

SEQ ID NO: 650 - DNA, 27 bp, Artificial
  B2M gRNA target site sequence
tttttgggatggaatctcattccattg

SEQ ID NO: 651 - DNA, 27 bp, Artificial
  B2M gRNA target site sequence
ttttttgggatggaatctcattccatt

SEQ ID NO: 652 - DNA, 27 bp, Artificial
  B2M gRNA target site sequence
tttattttttgggatggaatctcattc

SEQ ID NO: 653 - DNA, 27 bp, Artificial
  B2M gRNA target site sequence
ttttattttttgggatggaatctcatt

SEQ ID NO: 654 - DNA, 27 bp, Artificial
  B2M gRNA target site sequence
tttttattttttgggatggaatctcat

SEQ ID NO: 655 - DNA, 27 bp, Artificial
  B2M gRNA target site sequence
ttttttattttttgggatggaatctca

SEQ ID NO: 656 - DNA, 27 bp, Artificial
  B2M gRNA target site sequence
tttttttattttttgggatggaatctc

SEQ ID NO: 657 - DNA, 27 bp, Artificial
  B2M gRNA target site sequence
tttatttttttattttttgggatggaa

SEQ ID NO: 658 - DNA, 27 bp, Artificial
  B2M gRNA target site sequence
ttttatttttttattttttgggatgga

SEQ ID NO: 659 - DNA, 27 bp, Artificial
  B2M gRNA target site sequence
tttttatttttttattttttgggatgg

SEQ ID NO: 660 - DNA, 27 bp, Artificial
  B2M gRNA target site sequence
ttttttatttttttattttttgggatg

SEQ ID NO: 661 - DNA, 27 bp, Artificial
  B2M gRNA target site sequence
tttttttatttttttattttttgggat

SEQ ID NO: 662 - DNA, 27 bp, Artificial
  B2M gRNA target site sequence
tttatttttttatttttttattttttg

SEQ ID NO: 663 - DNA, 27 bp, Artificial
  B2M gRNA target site sequence
tttctaaactgtatgaagtgtctagta

SEQ ID NO: 664 - DNA, 27 bp, Artificial
  B2M gRNA target site sequence
ttttctaaactgtatgaagtgtctagt

SEQ ID NO: 665 - DNA, 27 bp, Artificial
  B2M gRNA target site sequence
tttagaaaatcagatgggtgtagatca

SEQ ID NO: 666 - DNA, 27 bp, Artificial
  B2M gRNA target site sequence
tttggttcctgctcctgccttgatcta

SEQ ID NO: 667 - DNA, 27 bp, Artificial
  B2M gRNA target site sequence
ttttggttcctgctcctgccttgatct

SEQ ID NO: 668 - DNA, 27 bp, Artificial
  B2M gRNA target site sequence
tttttggttcctgctcctgccttgatc

SEQ ID NO: 669 - DNA, 27 bp, Artificial
  B2M gRNA target site sequence
tttctttttggttcctgctcctgcctt

SEQ ID NO: 670 - DNA, 27 bp, Artificial
  B2M gRNA target site sequence
tttatgcctttctttttggttcctgct

SEQ ID NO: 671 - DNA, 27 bp, Artificial
  B2M gRNA target site sequence
tttcttatgtttatgcctttctttttg

SEQ ID NO: 672 - DNA, 27 bp, Artificial
  B2M gRNA target site sequence
ttttcttatgtttatgcctttcttttt

SEQ ID NO: 673 - DNA, 27 bp, Artificial
  B2M gRNA target site sequence
tttttcttatgtttatgcctttctttt

SEQ ID NO: 674 - DNA, 27 bp, Artificial
  B2M gRNA target site sequence
ttttttcttatgtttatgcctttcttt

SEQ ID NO: 675 - DNA, 27 bp, Artificial
  B2M gRNA target site sequence
tttttttcttatgtttatgcctttctt

SEQ ID NO: 676 - DNA, 27 bp, Artificial
  B2M gRNA target site sequence
ttttttttcttatgtttatgcctttct

SEQ ID NO: 677 - DNA, 27 bp, Artificial
  B2M gRNA target site sequence
tttccaccccttccattttttttctta

SEQ ID NO: 678 - DNA, 27 bp, Artificial
  B2M gRNA target site sequence
tttgatgggggctattatgaactgaga

SEQ ID NO: 679 - DNA, 27 bp, Artificial
  B2M gRNA target site sequence
tttctcagttcataatagcccccatca

SEQ ID NO: 680 - DNA, 27 bp, Artificial
  B2M gRNA target site sequence
tttcaaagttcatttctcagttcataa

SEQ ID NO: 681 - DNA, 27 bp, Artificial
  B2M gRNA target site sequence
ttttcaaagttcatttctcagttcata

SEQ ID NO: 682 - DNA, 27 bp, Artificial
  B2M gRNA target site sequence
tttggccccaagatacttttcaaagtt

SEQ ID NO: 683 - DNA, 27 bp, Artificial
  B2M gRNA target site sequence
tttgaaaagtatcttggggccaaatca

SEQ ID NO: 684 - DNA, 27 bp, Artificial
  B2M gRNA target site sequence
tttctctggaggctctcaaggacttct

SEQ ID NO: 685 - DNA, 27 bp, Artificial
  B2M gRNA target site sequence
tttaagagcctttctctggaggctctc

SEQ ID NO: 686 - DNA, 27 bp, Artificial
  B2M gRNA target site sequence
ttttaagagcctttctctggaggctct

SEQ ID NO: 687 - DNA, 27 bp, Artificial
  B2M gRNA target site sequence
tttttaagagcctttctctggaggctc

SEQ ID NO: 688 - DNA, 27 bp, Artificial
  B2M gRNA target site sequence
tttctagcagtatcttctgtcactgga

SEQ ID NO: 689 - DNA, 27 bp, Artificial
  B2M gRNA target site sequence
tttctagcagatttctagcagtatctt

SEQ ID NO: 690 - DNA, 27 bp, Artificial
  B2M gRNA target site sequence
ttttctagcagatttctagcagtatct

SEQ ID NO: 691 - DNA, 27 bp, Artificial
  B2M gRNA target site sequence
tttttctagcagatttctagcagtatc

SEQ ID NO: 692 - DNA, 27 bp, Artificial
  B2M gRNA target site sequence
ttttttctagcagatttctagcagtat

SEQ ID NO: 693 - DNA, 27 bp, Artificial
  B2M gRNA target site sequence
tttttttctagcagatttctagcagta

SEQ ID NO: 694 - DNA, 27 bp, Artificial
  B2M gRNA target site sequence
ttttttttctagcagatttctagcagt

SEQ ID NO: 695 - DNA, 27 bp, Artificial
  B2M gRNA target site sequence
tttgttttttttctagcagatttctag

SEQ ID NO: 696 - DNA, 27 bp, Artificial
  B2M gRNA target site sequence
ttttgttttttttctagcagatttcta

SEQ ID NO: 697 - DNA, 27 bp, Artificial
  B2M gRNA target site sequence
tttttgttttttttctagcagatttct

SEQ ID NO: 698 - DNA, 27 bp, Artificial
  B2M gRNA target site sequence
ttttttgttttttttctagcagatttc

SEQ ID NO: 699 - DNA, 27 bp, Artificial
  B2M gRNA target site sequence
tttccctcataattcctctatacatgc

SEQ ID NO: 700 - DNA, 27 bp, Artificial
  B2M gRNA target site sequence
tttgaagaataaaccgtgacttggtat

SEQ ID NO: 701 - DNA, 27 bp, Artificial
  B2M gRNA target site sequence
ttttgaagaataaaccgtgacttggta

SEQ ID NO: 702 - DNA, 27 bp, Artificial
  B2M gRNA target site sequence
tttattcttcaaaatggaggtggcttg

SEQ ID NO: 703 - DNA, 27 bp, Artificial
  B2M gRNA target site sequence
tttccactctggccaaatgagcttcca

SEQ ID NO: 704 - DNA, 27 bp, Artificial
  B2M gRNA target site sequence
tttggccagagtggaaatggaattggg

SEQ ID NO: 705 - DNA, 27 bp, Artificial
  B2M gRNA target site sequence
tttctcccaattccatttccactctgg

SEQ ID NO: 706 - DNA, 27 bp, Artificial
  B2M gRNA target site sequence
tttggtcatcgatttctcccaattcca

SEQ ID NO: 707 - DNA, 27 bp, Artificial
  B2M gRNA target site sequence
tttacatttggtcatcgatttctccca

SEQ ID NO: 708 - DNA, 27 bp, Artificial
  B2M gRNA target site sequence
tttcacttggggctaacttggtgtcaa

SEQ ID NO: 709 - DNA, 27 bp, Artificial
  B2M gRNA target site sequence
ttttcccgatattcctcaggtactcca

SEQ ID NO: 710 - DNA, 27 bp, Artificial
  B2M gRNA target site sequence
tttcccgatattcctcaggtactccaa

SEQ ID NO: 711 - DNA, 27 bp, Artificial
  B2M gRNA target site sequence
tttggagtacctgaggaatatcgggaa

SEQ ID NO: 712 - DNA, 27 bp, Artificial
  B2M gRNA target site sequence
tttactcacgtcatccagcagagaatg

SEQ ID NO: 713 - DNA, 27 bp, Artificial
  B2M gRNA target site sequence
tttccattctctgctggatgacgtgag

SEQ ID NO: 714 - DNA, 27 bp, Artificial
  B2M gRNA target site sequence
tttgactttccattctctgctggatga

SEQ ID NO: 715 - DNA, 27 bp, Artificial
  B2M gRNA target site sequence
tttcctgaattgctatgtgtctgggtt

SEQ ID NO: 716 - DNA, 27 bp, Artificial
  B2M gRNA target site sequence
tttcatccatccgacattgaagttgac

SEQ ID NO: 717 - DNA, 27 bp, Artificial
  B2M gRNA target site sequence
tttcaattctctctccattcttcagta

SEQ ID NO: 718 - DNA, 27 bp, Artificial
  B2M gRNA target site sequence
ttttcaattctctctccattcttcagt

SEQ ID NO: 719 - DNA, 27 bp, Artificial
  B2M gRNA target site sequence
tttttcaattctctctccattcttcag

SEQ ID NO: 720 - DNA, 27 bp, Artificial
  B2M gRNA target site sequence
tttcagcaaggactggtctttctatct

SEQ ID NO: 721 - DNA, 27 bp, Artificial
  B2M gRNA target site sequence
tttctatctcttgtactacactgaatt

SEQ ID NO: 722 - DNA, 27 bp, Artificial
  B2M gRNA target site sequence
tttcagtgggggtgaattcagtgtagt

SEQ ID NO: 723 - DNA, 27 bp, Artificial
  B2M gRNA target site sequence
ttttcagtgggggtgaattcagtgtag

SEQ ID NO: 724 - DNA, 27 bp, Artificial
  B2M gRNA target site sequence
tttttcagtgggggtgaattcagtgta

SEQ ID NO: 725 - DNA, 27 bp, Artificial
  B2M gRNA target site sequence
tttgtcacagcccaagatagttaagtg

SEQ ID NO: 726 - DNA, 27 bp, Artificial
  B2M gRNA target site sequence
tttcagcagcttacaaaagaatgtaag

SEQ ID NO: 727 - DNA, 27 bp, Artificial
  B2M gRNA target site sequence
ttttgtaagctgctgaaagttgtgtat

SEQ ID NO: 728 - DNA, 27 bp, Artificial
  B2M gRNA target site sequence
tttgtaagctgctgaaagttgtgtatg

SEQ ID NO: 729 - DNA, 27 bp, Artificial
  B2M gRNA target site sequence
tttatgatatgactactcatacacaac

SEQ ID NO: 730 - DNA, 27 bp, Artificial
  B2M gRNA target site sequence
tttatatcaaagcagctttatgatatg

SEQ ID NO: 731 - DNA, 27 bp, Artificial
  B2M gRNA target site sequence
ttttatatcaaagcagctttatgatat

SEQ ID NO: 732 - DNA, 27 bp, Artificial
  B2M gRNA target site sequence
tttttatatcaaagcagctttatgata

SEQ ID NO: 733 - DNA, 27 bp, Artificial
  B2M gRNA target site sequence
ttttttatatcaaagcagctttatgat

SEQ ID NO: 734 - DNA, 27 bp, Artificial
  B2M gRNA target site sequence
tttgatataaaaaaggtctatggccat

SEQ ID NO: 735 - DNA, 27 bp, Artificial
  B2M gRNA target site sequence
tttatatcagatgggatgggactcatt

SEQ ID NO: 736 - DNA, 27 bp, Artificial
  B2M gRNA target site sequence
tttaagaacattccctgacaatcccaa

SEQ ID NO: 737 - DNA, 27 bp, Artificial
  B2M gRNA target site sequence
tttctgaaccagtagtttccctgcagt

SEQ ID NO: 738 - DNA, 27 bp, Artificial
  B2M gRNA target site sequence
tttccctgcagttgagcagggagcagc

SEQ ID NO: 739 - DNA, 27 bp, Artificial
  B2M gRNA target site sequence
tttgtgcaagtgctgctgctgctccct

SEQ ID NO: 740 - DNA, 27 bp, Artificial
  B2M gRNA target site sequence
ttttgtggcagcttcaggtatatttag

SEQ ID NO: 741 - DNA, 27 bp, Artificial
  B2M gRNA target site sequence
tttgtggcagcttcaggtatatttagc

SEQ ID NO: 742 - DNA, 27 bp, Artificial
  B2M gRNA target site sequence
tttagcactgaacgaacatctcaagaa

SEQ ID NO: 743 - DNA, 27 bp, Artificial
  B2M gRNA target site sequence
tttgtttgtaagtcctgctgtcctagc

SEQ ID NO: 744 - DNA, 27 bp, Artificial
  B2M gRNA target site sequence
tttgtaagtcctgctgtcctagcatcc

SEQ ID NO: 745 - DNA, 27 bp, Artificial
  B2M gRNA target site sequence
tttctggctggattggtatctgaggct

SEQ ID NO: 746 - DNA, 27 bp, Artificial
  B2M gRNA target site sequence
tttagagctacccagcaggaacaagcc

SEQ ID NO: 747 - DNA, 27 bp, Artificial
  B2M gRNA target site sequence
tttctaaccattttagacatttgttag

SEQ ID NO: 748 - DNA, 27 bp, Artificial
  B2M gRNA target site sequence
ttttagacatttgttagtacatggtat

SEQ ID NO: 749 - DNA, 27 bp, Artificial
  B2M gRNA target site sequence
tttagacatttgttagtacatggtatt

SEQ ID NO: 750 - DNA, 27 bp, Artificial
  B2M gRNA target site sequence
tttaaaataccatgtactaacaaatgt

SEQ ID NO: 751 - DNA, 27 bp, Artificial
  B2M gRNA target site sequence
ttttaaaataccatgtactaacaaatg

SEQ ID NO: 752 - DNA, 27 bp, Artificial
  B2M gRNA target site sequence
tttgttagtacatggtattttaaaagt

SEQ ID NO: 753 - DNA, 27 bp, Artificial
  B2M gRNA target site sequence
tttacttttaaaataccatgtactaac

SEQ ID NO: 754 - DNA, 27 bp, Artificial
  B2M gRNA target site sequence
ttttacttttaaaataccatgtactaa

SEQ ID NO: 755 - DNA, 27 bp, Artificial
  B2M gRNA target site sequence
ttttaaaagtaaaacttaatgtcttcc

SEQ ID NO: 756 - DNA, 27 bp, Artificial
  B2M gRNA target site sequence
tttaaaagtaaaacttaatgtcttcct

SEQ ID NO: 757 - DNA, 27 bp, Artificial
  B2M gRNA target site sequence
ttttttttctccactgtctttttcata

SEQ ID NO: 758 - DNA, 27 bp, Artificial
  B2M gRNA target site sequence
tttttttctccactgtctttttcatag

SEQ ID NO: 759 - DNA, 27 bp, Artificial
  B2M gRNA target site sequence
ttttttctccactgtctttttcataga

SEQ ID NO: 760 - DNA, 27 bp, Artificial
  B2M gRNA target site sequence
tttttctccactgtctttttcatagat

SEQ ID NO: 761 - DNA, 27 bp, Artificial
  B2M gRNA target site sequence
ttttctccactgtctttttcatagatc

SEQ ID NO: 762 - DNA, 27 bp, Artificial
  B2M gRNA target site sequence
tttctccactgtctttttcatagatcg

SEQ ID NO: 763 - DNA, 27 bp, Artificial
  B2M gRNA target site sequence
tttttcatagatcgagacatgtaagca

SEQ ID NO: 764 - DNA, 27 bp, Artificial
  B2M gRNA target site sequence
ttttcatagatcgagacatgtaagcag

SEQ ID NO: 765 - DNA, 27 bp, Artificial
  B2M gRNA target site sequence
tttcatagatcgagacatgtaagcagc

SEQ ID NO: 766 - DNA, 27 bp, Artificial
  B2M gRNA target site sequence
tttctcaaggtcaaaaacttacctcca

SEQ ID NO: 767 - DNA, 27 bp, Artificial
  B2M gRNA target site sequence
ttttctcaaggtcaaaaacttacctcc

SEQ ID NO: 768 - DNA, 27 bp, Artificial
  B2M gRNA target site sequence
tttttgaccttgagaaaatgtttttgt

SEQ ID NO: 769 - DNA, 27 bp, Artificial
  B2M gRNA target site sequence
ttttgaccttgagaaaatgtttttgtt

SEQ ID NO: 770 - DNA, 27 bp, Artificial
  B2M gRNA target site sequence
tttgaccttgagaaaatgtttttgttt

SEQ ID NO: 771 - DNA, 27 bp, Artificial
  B2M gRNA target site sequence
tttttgtttcactgtcctgaggactat

SEQ ID NO: 772 - DNA, 27 bp, Artificial
  B2M gRNA target site sequence
ttttgtttcactgtcctgaggactatt

SEQ ID NO: 773 - DNA, 27 bp, Artificial
  B2M gRNA target site sequence
tttgtttcactgtcctgaggactattt

SEQ ID NO: 774 - DNA, 27 bp, Artificial
  B2M gRNA target site sequence
tttcactgtcctgaggactatttatag

SEQ ID NO: 775 - DNA, 27 bp, Artificial
  B2M gRNA target site sequence
tttatagacagctctaacatgataacc

SEQ ID NO: 776 - DNA, 27 bp, Artificial
  B2M gRNA target site sequence
tttccctgctaaaatgttactctgtca

SEQ ID NO: 777 - DNA, 27 bp, Artificial
  B2M gRNA target site sequence
ttttagcagggaaagaagaatcctaca

SEQ ID NO: 778 - DNA, 27 bp, Artificial
  B2M gRNA target site sequence
tttagcagggaaagaagaatcctacag

SEQ ID NO: 779 - DNA, 27 bp, Artificial
  B2M gRNA target site sequence
tttgccctctctgtagagggtcagtaa

SEQ ID NO: 780 - DNA, 27 bp, Artificial
  B2M gRNA target site sequence
tttatcctgcaataccatactggcagt

SEQ ID NO: 781 - DNA, 27 bp, Artificial
  B2M gRNA target site sequence
tttgatctttcttctgccatttccaca

SEQ ID NO: 782 - DNA, 27 bp, Artificial
  B2M gRNA target site sequence
tttcttctgccatttccacattggaca

SEQ ID NO: 783 - DNA, 27 bp, Artificial
  B2M gRNA target site sequence
tttccacattggacatctctgctgagg

SEQ ID NO: 784 - DNA, 27 bp, Artificial
  B2M gRNA target site sequence
tttctctcctcagcagagatgtccaat

SEQ ID NO: 785 - DNA, 27 bp, Artificial
  B2M gRNA target site sequence
ttttctctcctcagcagagatgtccaa

SEQ ID NO: 786 - DNA, 27 bp, Artificial
  B2M gRNA target site sequence
ttttcctttgtataatgttgttttatt

SEQ ID NO: 787 - DNA, 27 bp, Artificial
  B2M gRNA target site sequence
tttcctttgtataatgttgttttattc

SEQ ID NO: 788 - DNA, 27 bp, Artificial
  B2M gRNA target site sequence
tttgtataatgttgttttattcttcag

SEQ ID NO: 789 - DNA, 27 bp, Artificial
  B2M gRNA target site sequence
ttttattcttcagacagaagagaggag

SEQ ID NO: 790 - DNA, 27 bp, Artificial
  B2M gRNA target site sequence
tttattcttcagacagaagagaggagt

SEQ ID NO: 791 - DNA, 27 bp, Artificial
  B2M gRNA target site sequence
tttgcctcttagaggttcccaggccac

SEQ ID NO: 792 - DNA, 27 bp, Artificial
  B2M gRNA target site sequence
tttatctcctctagtggcctgggaacc

SEQ ID NO: 793 - DNA, 27 bp, Artificial
  B2M gRNA target site sequence
tttccctttatctcctctagtggcctg

SEQ ID NO: 794 - DNA, 27 bp, Artificial
  B2M gRNA target site sequence
tttggactccaactaaagatgcagaga

SEQ ID NO: 795 - DNA, 27 bp, Artificial
  B2M gRNA target site sequence
tttagttggagtccaaaggcttttcaa

SEQ ID NO: 796 - DNA, 27 bp, Artificial
  B2M gRNA target site sequence
tttcattgaaaagcctttggactccaa

SEQ ID NO: 797 - DNA, 27 bp, Artificial
  B2M gRNA target site sequence
ttttcaatgaaattctactgcccaggg

SEQ ID NO: 798 - DNA, 27 bp, Artificial
  B2M gRNA target site sequence
tttcaatgaaattctactgcccagggt

SEQ ID NO: 799 - DNA, 27 bp, Artificial
  B2M gRNA target site sequence
tttcagcatcaatgtaccctgggcagt

SEQ ID NO: 800 - DNA, 27 bp, Artificial
  B2M gRNA target site sequence
tttgaatggggtttcagcatcaatgta

SEQ ID NO: 801 - DNA, 27 bp, Artificial
  B2M gRNA target site sequence
tttgggagagcatcaggaaggtggatg

SEQ ID NO: 802 - DNA, 27 bp, Artificial
  B2M gRNA target site sequence
tttactaacagtgtgactgggcagatc

SEQ ID NO: 803 - DNA, 27 bp, Artificial
  B2M gRNA target site sequence
tttctcagaacatgtccccgtcattaa

SEQ ID NO: 804 - DNA, 27 bp, Artificial
  B2M gRNA target site sequence
tttgtgtaagcatttctcagaacatgt

SEQ ID NO: 805 - DNA, 27 bp, Artificial
  B2M gRNA target site sequence
tttgtagtctaggagcaataggctata

SEQ ID NO: 806 - DNA, 27 bp, Artificial
  B2M gRNA target site sequence
tttagatacacaaatacttaccattgt

SEQ ID NO: 807 - DNA, 27 bp, Artificial
  B2M gRNA target site sequence
tttgtgtatctaaacatagaagttgca

SEQ ID NO: 808 - DNA, 27 bp, Artificial
  B2M gRNA target site sequence
tttactgcaacttctatgtttagatac

SEQ ID NO: 809 - DNA, 27 bp, Artificial
  B2M gRNA target site sequence
ttttactgcaacttctatgtttagata

SEQ ID NO: 810 - DNA, 27 bp, Artificial
  B2M gRNA target site sequence
tttttactgcaacttctatgtttagat

SEQ ID NO: 811 - DNA, 27 bp, Artificial
  B2M gRNA target site sequence
ttttaatcttatgagaccactgtcata

SEQ ID NO: 812 - DNA, 27 bp, Artificial
  B2M gRNA target site sequence
tttaatcttatgagaccactgtcatat

SEQ ID NO: 813 - DNA, 27 bp, Artificial
  B2M gRNA target site sequence
tttggtcaatgatggactgtatatatg

SEQ ID NO: 814 - DNA, 27 bp, Artificial
  B2M gRNA target site sequence
ttttggtcaatgatggactgtatatat

SEQ ID NO: 815 - DNA, 27 bp, Artificial
  B2M gRNA target site sequence
ttttttcttctaagattttgggagcac

SEQ ID NO: 816 - DNA, 27 bp, Artificial
  B2M gRNA target site sequence
tttttcttctaagattttgggagcacc

SEQ ID NO: 817 - DNA, 27 bp, Artificial
  B2M gRNA target site sequence
ttttcttctaagattttgggagcacca

SEQ ID NO: 818 - DNA, 27 bp, Artificial
  B2M gRNA target site sequence
tttcttctaagattttgggagcaccaa

SEQ ID NO: 819 - DNA, 27 bp, Artificial
  B2M gRNA target site sequence
tttggtgctcccaaaatcttagaagaa

SEQ ID NO: 820 - DNA, 27 bp, Artificial
  B2M gRNA target site sequence
ttttgggagcaccaaagggatacacta

SEQ ID NO: 821 - DNA, 27 bp, Artificial
  B2M gRNA target site sequence
tttgggagcaccaaagggatacactaa

SEQ ID NO: 822 - DNA, 27 bp, Artificial
  B2M gRNA target site sequence
tttataatgggtttggagaactgtctg

SEQ ID NO: 823 - DNA, 27 bp, Artificial
  B2M gRNA target site sequence
tttggagaactgtctgcagctacttct

SEQ ID NO: 824 - DNA, 27 bp, Artificial
  B2M gRNA target site sequence
tttaaaagaagtagctgcagacagttc

SEQ ID NO: 825 - DNA, 27 bp, Artificial
  B2M gRNA target site sequence
ttttaaaagaagtagctgcagacagtt

SEQ ID NO: 826 - DNA, 27 bp, Artificial
  B2M gRNA target site sequence
tttttaaaagaagtagctgcagacagt

SEQ ID NO: 827 - DNA, 27 bp, Artificial
  B2M gRNA target site sequence
ttttaaaaaggtgatctacacagtaga

SEQ ID NO: 828 - DNA, 27 bp, Artificial
  B2M gRNA target site sequence
tttaaaaaggtgatctacacagtagaa

SEQ ID NO: 829 - DNA, 27 bp, Artificial
  B2M gRNA target site sequence
tttctactgtgtagatcacctttttaa

SEQ ID NO: 830 - DNA, 27 bp, Artificial
  B2M gRNA target site sequence
tttggattgcagatctcattaccaaac

SEQ ID NO: 831 - DNA, 27 bp, Artificial
  B2M gRNA target site sequence
tttggtaatgagatctgcaatccaaat

SEQ ID NO: 832 - DNA, 27 bp, Artificial
  B2M gRNA target site sequence
tttatttggattgcagatctcattacc

SEQ ID NO: 833 - DNA, 27 bp, Artificial
  B2M gRNA target site sequence
ttttatttggattgcagatctcattac

SEQ ID NO: 834 - DNA, 27 bp, Artificial
  B2M gRNA target site sequence
tttattttatttggattgcagatctca

SEQ ID NO: 835 - DNA, 27 bp, Artificial
  B2M gRNA target site sequence
tttttcttttcttttcaggtttgaaga

SEQ ID NO: 836 - DNA, 27 bp, Artificial
  B2M gRNA target site sequence
ttttcttttcttttcaggtttgaagat

SEQ ID NO: 837 - DNA, 27 bp, Artificial
  B2M gRNA target site sequence
tttcttttcttttcaggtttgaagatg

SEQ ID NO: 838 - DNA, 27 bp, Artificial
  B2M gRNA target site sequence
ttttcttttcaggtttgaagatgccgc

SEQ ID NO: 839 - DNA, 27 bp, Artificial
  B2M gRNA target site sequence
tttcttttcaggtttgaagatgccgca

SEQ ID NO: 840 - DNA, 27 bp, Artificial
  B2M gRNA target site sequence
ttttcaggtttgaagatgccgcatttg

SEQ ID NO: 841 - DNA, 27 bp, Artificial
  B2M gRNA target site sequence
tttcaggtttgaagatgccgcatttgg

SEQ ID NO: 842 - DNA, 27 bp, Artificial
  B2M gRNA target site sequence
tttgaagatgccgcatttggattggat

SEQ ID NO: 843 - DNA, 27 bp, Artificial
  B2M gRNA target site sequence
tttggaattcatccaatccaaatgcgg

SEQ ID NO: 844 - DNA, 27 bp, Artificial
  B2M gRNA target site sequence
tttggattggatgaattccaaattctg

SEQ ID NO: 845 - DNA, 27 bp, Artificial
  B2M gRNA target site sequence
tttttaatattgatatgcttatacact

SEQ ID NO: 846 - DNA, 27 bp, Artificial
  B2M gRNA target site sequence
ttttaatattgatatgcttatacactt

SEQ ID NO: 847 - DNA, 27 bp, Artificial
  B2M gRNA target site sequence
tttaatattgatatgcttatacactta

SEQ ID NO: 848 - DNA, 27 bp, Artificial
  B2M gRNA target site sequence
tttgtgcataaagtgtaagtgtataag

SEQ ID NO: 849 - DNA, 27 bp, Artificial
  B2M gRNA target site sequence
ttttgtgcataaagtgtaagtgtataa

SEQ ID NO: 850 - DNA, 27 bp, Artificial
  B2M gRNA target site sequence
tttatgcacaaaatgtagggttataat

SEQ ID NO: 851 - DNA, 27 bp, Artificial
  B2M gRNA target site sequence
tttataattctactttgagtgctgtct

SEQ ID NO: 852 - DNA, 27 bp, Artificial
  B2M gRNA target site sequence
tttgagtgctgtctccatgtttgatgt

SEQ ID NO: 853 - DNA, 27 bp, Artificial
  B2M gRNA target site sequence
tttgatgtatctgagcaggttgctcca

SEQ ID NO: 854 - DNA, 27 bp, Artificial
  B2M gRNA target site sequence
tttgaactcttcaatctcttgcactca

SEQ ID NO: 855 - DNA, 27 bp, Artificial
  B2M gRNA target site sequence
tttgagtgcaagagattgaagagttca

SEQ ID NO: 856 - DNA, 27 bp, Artificial
  B2M gRNA target site sequence
tttacatactctgcttagaatttgggg

SEQ ID NO: 857 - DNA, 27 bp, Artificial
  B2M gRNA target site sequence
tttcccccaaattctaagcagagtatg

SEQ ID NO: 858 - DNA, 27 bp, Artificial
  B2M gRNA target site sequence
ttttcccccaaattctaagcagagtat

SEQ ID NO: 859 - DNA, 27 bp, Artificial
  B2M gRNA target site sequence
tttctaaattttcccccaaattctaag

SEQ ID NO: 860 - DNA, 27 bp, Artificial
  B2M gRNA target site sequence
tttgggggaaaatttagaaatataatt

SEQ ID NO: 861 - DNA, 27 bp, Artificial
  B2M gRNA target site sequence
tttagaaatataattgacaggattatt

SEQ ID NO: 862 - DNA, 27 bp, Artificial
  B2M gRNA target site sequence
tttccaataatcctgtcaattatattt

SEQ ID NO: 863 - DNA, 27 bp, Artificial
  B2M gRNA target site sequence
tttcattcattataacaaatttccaat

SEQ ID NO: 864 - DNA, 27 bp, Artificial
  B2M gRNA target site sequence
tttgttataatgaatgaaacattttgt

SEQ ID NO: 865 - DNA, 27 bp, Artificial
  B2M gRNA target site sequence
ttttgtcatataagattcatatttact

SEQ ID NO: 866 - DNA, 27 bp, Artificial
  B2M gRNA target site sequence
tttgtcatataagattcatatttactt

SEQ ID NO: 867 - DNA, 27 bp, Artificial
  B2M gRNA target site sequence
tttatcaaatgtataagaagtaaatat

SEQ ID NO: 868 - DNA, 27 bp, Artificial
  B2M gRNA target site sequence
tttacttcttatacatttgataaagta

SEQ ID NO: 869 - DNA, 27 bp, Artificial
  B2M gRNA target site sequence
tttgataaagtaaggcatggttgtggt

SEQ ID NO: 870 - DNA, 27 bp, Artificial
  B2M gRNA target site sequence
tttaacttgtggaacaaaaataaacca

SEQ ID NO: 871 - DNA, 27 bp, Artificial
  B2M gRNA target site sequence
tttatttttgttccacaagttaaataa

SEQ ID NO: 872 - DNA, 27 bp, Artificial
  B2M gRNA target site sequence
tttatttaacttgtggaacaaaaataa

SEQ ID NO: 873 - DNA, 27 bp, Artificial
  B2M gRNA target site sequence
tttttgttccacaagttaaataaatca

SEQ ID NO: 874 - DNA, 27 bp, Artificial
  B2M gRNA target site sequence
ttttgttccacaagttaaataaatcat

SEQ ID NO: 875 - DNA, 27 bp, Artificial
  B2M gRNA target site sequence
tttgttccacaagttaaataaatcata

SEQ ID NO: 876 - DNA, 27 bp, Artificial
  B2M gRNA target site sequence
tttatgatttatttaacttgtggaaca

SEQ ID NO: 877 - DNA, 27 bp, Artificial
  B2M gRNA target site sequence
ttttatgatttatttaacttgtggaac

SEQ ID NO: 878 - DNA, 27 bp, Artificial
  B2M gRNA target site sequence
tttgaaaataaaggggtaatagtggga

SEQ ID NO: 879 - DNA, 27 bp, Artificial
  B2M gRNA target site sequence
tttccctgtttgaaaataaaggggtaa

SEQ ID NO: 880 - DNA, 27 bp, Artificial
  B2M gRNA target site sequence
tttattttcaaacagggaaacagtctt

SEQ ID NO: 881 - DNA, 20 bp, Artificial
  B2M gRNA target site sequence
cctgcgggccttgtcctgat

SEQ ID NO: 882 - DNA, 20 bp, Artificial
  B2M gRNA target site sequence
cgggccttgtcctgattggc

SEQ ID NO: 883 - DNA, 20 bp, Artificial
  B2M gRNA target site sequence
gggccttgtcctgattggct

SEQ ID NO: 884 - DNA, 20 bp, Artificial
  B2M gRNA target site sequence
gctgggcacgcgtttaatat

SEQ ID NO: 885 - DNA, 20 bp, Artificial
  B2M gRNA target site sequence
gggcacgcgtttaatataag

SEQ ID NO: 886 - DNA, 20 bp, Artificial
  B2M gRNA target site sequence
gcacgcgtttaatataagtg

SEQ ID NO: 887 - DNA, 20 bp, Artificial
  B2M gRNA target site sequence
cacgcgtttaatataagtgg

SEQ ID NO: 888 - DNA, 20 bp, Artificial
  B2M gRNA target site sequence
tataagtggaggcgtcgcgc

SEQ ID NO: 889 - DNA, 20 bp, Artificial
  B2M gRNA target site sequence
aagtggaggcgtcgcgctgg

SEQ ID NO: 890 - DNA, 20 bp, Artificial
  B2M gRNA target site sequence
agtggaggcgtcgcgctggc

SEQ ID NO: 891 - DNA, 20 bp, Artificial
  B2M gRNA target site sequence
cgcgctggcgggcattcctg

SEQ ID NO: 892 - DNA, 20 bp, Artificial
  B2M gRNA target site sequence
gcgggcattcctgaagctga

SEQ ID NO: 893 - DNA, 20 bp, Artificial
  B2M gRNA target site sequence
ttcctgaagctgacagcatt

SEQ ID NO: 894 - DNA, 20 bp, Artificial
  B2M gRNA target site sequence
tcctgaagctgacagcattc

SEQ ID NO: 895 - DNA, 20 bp, Artificial
  B2M gRNA target site sequence
aagctgacagcattcgggcc

SEQ ID NO: 896 - DNA, 20 bp, Artificial
  B2M gRNA target site sequence
ggccgagatgtctcgctccg

SEQ ID NO: 897 - DNA, 20 bp, Artificial
  B2M gRNA target site sequence
gatgtctcgctccgtggcct

SEQ ID NO: 898 - DNA, 20 bp, Artificial
  B2M gRNA target site sequence
ctcgcgctactctctctttc

SEQ ID NO: 899 - DNA, 20 bp, Artificial
  B2M gRNA target site sequence
gctactctctctttctggcc

SEQ ID NO: 900 - DNA, 20 bp, Artificial
  B2M gRNA target site sequence
tactctctctttctggcctg

SEQ ID NO: 901 - DNA, 20 bp, Artificial
  B2M gRNA target site sequence
actctctctttctggcctgg

SEQ ID NO: 902 - DNA, 20 bp, Artificial
  B2M gRNA target site sequence
tttctggcctggaggctatc

SEQ ID NO: 903 - DNA, 20 bp, Artificial
  B2M gRNA target site sequence
gcctggaggctatccagcgt

SEQ ID NO: 904 - DNA, 20 bp, Artificial
  B2M gRNA target site sequence
tctctcctaccctcccgctc

SEQ ID NO: 905 - DNA, 20 bp, Artificial
  B2M gRNA target site sequence
ctcccgctctgcaccctctg

SEQ ID NO: 906 - DNA, 20 bp, Artificial
  B2M gRNA target site sequence
ctccgtgacttcccttctcc

SEQ ID NO: 907 - DNA, 20 bp, Artificial
  B2M gRNA target site sequence
tcccttctccaagttctcct

SEQ ID NO: 908 - DNA, 20 bp, Artificial
  B2M gRNA target site sequence
cttctccaagttctccttgg

SEQ ID NO: 909 - DNA, 20 bp, Artificial
  B2M gRNA target site sequence
ttctccttggtggcccgccg

SEQ ID NO: 910 - DNA, 20 bp, Artificial
  B2M gRNA target site sequence
tctccttggtggcccgccgt

SEQ ID NO: 911 - DNA, 20 bp, Artificial
  B2M gRNA target site sequence
ctccttggtggcccgccgtg

SEQ ID NO: 912 - DNA, 20 bp, Artificial
  B2M gRNA target site sequence
ttggtggcccgccgtggggc

SEQ ID NO: 913 - DNA, 20 bp, Artificial
  B2M gRNA target site sequence
ggcccgccgtggggctagtc

SEQ ID NO: 914 - DNA, 20 bp, Artificial
  B2M gRNA target site sequence
gcccgccgtggggctagtcc

SEQ ID NO: 915 - DNA, 20 bp, Artificial
  B2M gRNA target site sequence
cccgccgtggggctagtcca

SEQ ID NO: 916 - DNA, 20 bp, Artificial
  B2M gRNA target site sequence
ccgtggggctagtccagggc

SEQ ID NO: 917 - DNA, 20 bp, Artificial
  B2M gRNA target site sequence
gctagtccagggctggatct

SEQ ID NO: 918 - DNA, 20 bp, Artificial
  B2M gRNA target site sequence
ctagtccagggctggatctc

SEQ ID NO: 919 - DNA, 20 bp, Artificial
  B2M gRNA target site sequence
tagtccagggctggatctcg

SEQ ID NO: 920 - DNA, 20 bp, Artificial
  B2M gRNA target site sequence
tccagggctggatctcgggg

SEQ ID NO: 921 - DNA, 20 bp, Artificial
  B2M gRNA target site sequence
agggctggatctcggggaag

SEQ ID NO: 922 - DNA, 20 bp, Artificial
  B2M gRNA target site sequence
gctggatctcggggaagcgg

SEQ ID NO: 923 - DNA, 20 bp, Artificial
  B2M gRNA target site sequence
ctggatctcggggaagcggc

SEQ ID NO: 924 - DNA, 20 bp, Artificial
  B2M gRNA target site sequence
tggatctcggggaagcggcg

SEQ ID NO: 925 - DNA, 20 bp, Artificial
  B2M gRNA target site sequence
atctcggggaagcggcgggg

SEQ ID NO: 926 - DNA, 20 bp, Artificial
  B2M gRNA target site sequence
ggggaagcggcggggtggcc

SEQ ID NO: 927 - DNA, 20 bp, Artificial
  B2M gRNA target site sequence
gggaagcggcggggtggcct

SEQ ID NO: 928 - DNA, 20 bp, Artificial
  B2M gRNA target site sequence
gaagcggcggggtggcctgg

SEQ ID NO: 929 - DNA, 20 bp, Artificial
  B2M gRNA target site sequence
gcggcggggtggcctgggag

SEQ ID NO: 930 - DNA, 20 bp, Artificial
  B2M gRNA target site sequence
cggcggggtggcctgggagt

SEQ ID NO: 931 - DNA, 20 bp, Artificial
  B2M gRNA target site sequence
ggcggggtggcctgggagtg

SEQ ID NO: 932 - DNA, 20 bp, Artificial
  B2M gRNA target site sequence
ggggtggcctgggagtgggg

SEQ ID NO: 933 - DNA, 20 bp, Artificial
  B2M gRNA target site sequence
gggtggcctgggagtgggga

SEQ ID NO: 934 - DNA, 20 bp, Artificial
  B2M gRNA target site sequence
ggtggcctgggagtggggaa

SEQ ID NO: 935 - DNA, 20 bp, Artificial
  B2M gRNA target site sequence
gtggcctgggagtggggaag

SEQ ID NO: 936 - DNA, 20 bp, Artificial
  B2M gRNA target site sequence
tggcctgggagtggggaagg

SEQ ID NO: 937 - DNA, 20 bp, Artificial
  B2M gRNA target site sequence
tggggaagggggtgcgcacc

SEQ ID NO: 938 - DNA, 20 bp, Artificial
  B2M gRNA target site sequence
ggggaagggggtgcgcaccc

SEQ ID NO: 939 - DNA, 20 bp, Artificial
  B2M gRNA target site sequence
cgcgcgctacttgccccttt

SEQ ID NO: 940 - DNA, 20 bp, Artificial
  B2M gRNA target site sequence
gcgctacttgcccctttcgg

SEQ ID NO: 941 - DNA, 20 bp, Artificial
  B2M gRNA target site sequence
cgctacttgcccctttcggc

SEQ ID NO: 942 - DNA, 20 bp, Artificial
  B2M gRNA target site sequence
gctacttgcccctttcggcg

SEQ ID NO: 943 - DNA, 20 bp, Artificial
  B2M gRNA target site sequence
tacttgcccctttcggcggg

SEQ ID NO: 944 - DNA, 20 bp, Artificial
  B2M gRNA target site sequence
ttgcccctttcggcggggag

SEQ ID NO: 945 - DNA, 20 bp, Artificial
  B2M gRNA target site sequence
tgcccctttcggcggggagc

SEQ ID NO: 946 - DNA, 20 bp, Artificial
  B2M gRNA target site sequence
gcccctttcggcggggagca

SEQ ID NO: 947 - DNA, 20 bp, Artificial
  B2M gRNA target site sequence
cccctttcggcggggagcag

SEQ ID NO: 948 - DNA, 20 bp, Artificial
  B2M gRNA target site sequence
cctttcggcggggagcaggg

SEQ ID NO: 949 - DNA, 20 bp, Artificial
  B2M gRNA target site sequence
cggggagcaggggagacctt

SEQ ID NO: 950 - DNA, 20 bp, Artificial
  B2M gRNA target site sequence
caggggagacctttggccta

SEQ ID NO: 951 - DNA, 20 bp, Artificial
  B2M gRNA target site sequence
agacctttggcctacggcga

SEQ ID NO: 952 - DNA, 20 bp, Artificial
  B2M gRNA target site sequence
gacctttggcctacggcgac

SEQ ID NO: 953 - DNA, 20 bp, Artificial
  B2M gRNA target site sequence
cctttggcctacggcgacgg

SEQ ID NO: 954 - DNA, 20 bp, Artificial
  B2M gRNA target site sequence
ctttggcctacggcgacggg

SEQ ID NO: 955 - DNA, 20 bp, Artificial
  B2M gRNA target site sequence
tttggcctacggcgacggga

SEQ ID NO: 956 - DNA, 20 bp, Artificial
  B2M gRNA target site sequence
gcctacggcgacgggagggt

SEQ ID NO: 957 - DNA, 20 bp, Artificial
  B2M gRNA target site sequence
cctacggcgacgggagggtc

SEQ ID NO: 958 - DNA, 20 bp, Artificial
  B2M gRNA target site sequence
gcgacgggagggtcgggaca

SEQ ID NO: 959 - DNA, 20 bp, Artificial
  B2M gRNA target site sequence
gggagggtcgggacaaagtt

SEQ ID NO: 960 - DNA, 20 bp, Artificial
  B2M gRNA target site sequence
ggagggtcgggacaaagttt

SEQ ID NO: 961 - DNA, 20 bp, Artificial
  B2M gRNA target site sequence
gagggtcgggacaaagttta

SEQ ID NO: 962 - DNA, 20 bp, Artificial
  B2M gRNA target site sequence
acaaagtttagggcgtcgat

SEQ ID NO: 963 - DNA, 20 bp, Artificial
  B2M gRNA target site sequence
tttagggcgtcgataagcgt

SEQ ID NO: 964 - DNA, 20 bp, Artificial
  B2M gRNA target site sequence
tagggcgtcgataagcgtca

SEQ ID NO: 965 - DNA, 20 bp, Artificial
  B2M gRNA target site sequence
tcgataagcgtcagagcgcc

SEQ ID NO: 966 - DNA, 20 bp, Artificial
  B2M gRNA target site sequence
cgataagcgtcagagcgccg

SEQ ID NO: 967 - DNA, 20 bp, Artificial
  B2M gRNA target site sequence
aagcgtcagagcgccgaggt

SEQ ID NO: 968 - DNA, 20 bp, Artificial
  B2M gRNA target site sequence
agcgtcagagcgccgaggtt

SEQ ID NO: 969 - DNA, 20 bp, Artificial
  B2M gRNA target site sequence
gcgtcagagcgccgaggttg

SEQ ID NO: 970 - DNA, 20 bp, Artificial
  B2M gRNA target site sequence
cgtcagagcgccgaggttgg

SEQ ID NO: 971 - DNA, 20 bp, Artificial
  B2M gRNA target site sequence
tcagagcgccgaggttgggg

SEQ ID NO: 972 - DNA, 20 bp, Artificial
  B2M gRNA target site sequence
cagagcgccgaggttggggg

SEQ ID NO: 973 - DNA, 20 bp, Artificial
  B2M gRNA target site sequence
agagcgccgaggttggggga

SEQ ID NO: 974 - DNA, 20 bp, Artificial
  B2M gRNA target site sequence
gtttctcttccgctctttcg

SEQ ID NO: 975 - DNA, 20 bp, Artificial
  B2M gRNA target site sequence
tttctcttccgctctttcgc

SEQ ID NO: 976 - DNA, 20 bp, Artificial
  B2M gRNA target site sequence
ttctcttccgctctttcgcg

SEQ ID NO: 977 - DNA, 20 bp, Artificial
  B2M gRNA target site sequence
ccgctctttcgcggggcctc

SEQ ID NO: 978 - DNA, 20 bp, Artificial
  B2M gRNA target site sequence
cgcggggcctctggctcccc

SEQ ID NO: 979 - DNA, 20 bp, Artificial
  B2M gRNA target site sequence
ggcctctggctcccccagcg

SEQ ID NO: 980 - DNA, 20 bp, Artificial
  B2M gRNA target site sequence
tctggctcccccagcgcagc

SEQ ID NO: 981 - DNA, 20 bp, Artificial
  B2M gRNA target site sequence
tggctcccccagcgcagctg

SEQ ID NO: 982 - DNA, 20 bp, Artificial
  B2M gRNA target site sequence
ctcccccagcgcagctggag

SEQ ID NO: 983 - DNA, 20 bp, Artificial
  B2M gRNA target site sequence
tcccccagcgcagctggagt

SEQ ID NO: 984 - DNA, 20 bp, Artificial
  B2M gRNA target site sequence
cccccagcgcagctggagtg

SEQ ID NO: 985 - DNA, 20 bp, Artificial
  B2M gRNA target site sequence
ccccagcgcagctggagtgg

SEQ ID NO: 986 - DNA, 20 bp, Artificial
  B2M gRNA target site sequence
agcgcagctggagtggggga

SEQ ID NO: 987 - DNA, 20 bp, Artificial
  B2M gRNA target site sequence
gcgcagctggagtgggggac

SEQ ID NO: 988 - DNA, 20 bp, Artificial
  B2M gRNA target site sequence
cagctggagtgggggacggg

SEQ ID NO: 989 - DNA, 20 bp, Artificial
  B2M gRNA target site sequence
agctggagtgggggacgggt

SEQ ID NO: 990 - DNA, 20 bp, Artificial
  B2M gRNA target site sequence
ggacgggtaggctcgtccca

SEQ ID NO: 991 - DNA, 20 bp, Artificial
  B2M gRNA target site sequence
gacgggtaggctcgtcccaa

SEQ ID NO: 992 - DNA, 20 bp, Artificial
  B2M gRNA target site sequence
gtaggctcgtcccaaaggcg

SEQ ID NO: 993 - DNA, 20 bp, Artificial
  B2M gRNA target site sequence
cgtcccaaaggcgcggcgct

SEQ ID NO: 994 - DNA, 20 bp, Artificial
  B2M gRNA target site sequence
gtcccaaaggcgcggcgctg

SEQ ID NO: 995 - DNA, 20 bp, Artificial
  B2M gRNA target site sequence
cgctgaggtttgtgaacgcg

SEQ ID NO: 996 - DNA, 20 bp, Artificial
  B2M gRNA target site sequence
ctgaggtttgtgaacgcgtg

SEQ ID NO: 997 - DNA, 20 bp, Artificial
  B2M gRNA target site sequence
tgaggtttgtgaacgcgtgg

SEQ ID NO: 998 - DNA, 20 bp, Artificial
  B2M gRNA target site sequence
gaggtttgtgaacgcgtgga

SEQ ID NO: 999 - DNA, 20 bp, Artificial
  B2M gRNA target site sequence
aggtttgtgaacgcgtggag

SEQ ID NO: 1000 - DNA, 20 bp, Artificial
  B2M gRNA target site sequence
tgaacgcgtggaggggcgct

SEQ ID NO: 1001 - DNA, 20 bp, Artificial
  B2M gRNA target site sequence
gaacgcgtggaggggcgctt

SEQ ID NO: 1002 - DNA, 20 bp, Artificial
  B2M gRNA target site sequence
aacgcgtggaggggcgcttg

SEQ ID NO: 1003 - DNA, 20 bp, Artificial
  B2M gRNA target site sequence
gtggaggggcgcttggggtc

SEQ ID NO: 1004 - DNA, 20 bp, Artificial
  B2M gRNA target site sequence
tggaggggcgcttggggtct

SEQ ID NO: 1005 - DNA, 20 bp, Artificial
  B2M gRNA target site sequence
ggaggggcgcttggggtctg

SEQ ID NO: 1006 - DNA, 20 bp, Artificial
  B2M gRNA target site sequence
gaggggcgcttggggtctgg

SEQ ID NO: 1007 - DNA, 20 bp, Artificial
  B2M gRNA target site sequence
ggggcgcttggggtctgggg

SEQ ID NO: 1008 - DNA, 20 bp, Artificial
  B2M gRNA target site sequence
gggcgcttggggtctggggg

SEQ ID NO: 1009 - DNA, 20 bp, Artificial
  B2M gRNA target site sequence
ggtctgggggaggcgtcgcc

SEQ ID NO: 1010 - DNA, 20 bp, Artificial
  B2M gRNA target site sequence
gtctgggggaggcgtcgccc

SEQ ID NO: 1011 - DNA, 20 bp, Artificial
  B2M gRNA target site sequence
gggggaggcgtcgcccgggt

SEQ ID NO: 1012 - DNA, 20 bp, Artificial
  B2M gRNA target site sequence
ccgggtaagcctgtctgctg

SEQ ID NO: 1013 - DNA, 20 bp, Artificial
  B2M gRNA target site sequence
tgctgcggctctgcttccct

SEQ ID NO: 1014 - DNA, 20 bp, Artificial
  B2M gRNA target site sequence
cggctctgcttcccttagac

SEQ ID NO: 1015 - DNA, 20 bp, Artificial
  B2M gRNA target site sequence
gctctgcttcccttagactg

SEQ ID NO: 1016 - DNA, 20 bp, Artificial
  B2M gRNA target site sequence
tctgcttcccttagactgga

SEQ ID NO: 1017 - DNA, 20 bp, Artificial
  B2M gRNA target site sequence
tcccttagactggagagctg

SEQ ID NO: 1018 - DNA, 20 bp, Artificial
  B2M gRNA target site sequence
ggagagctgtggacttcgtc

SEQ ID NO: 1019 - DNA, 20 bp, Artificial
  B2M gRNA target site sequence
gagagctgtggacttcgtct

SEQ ID NO: 1020 - DNA, 20 bp, Artificial
  B2M gRNA target site sequence
acttcgtctaggcgcccgct

SEQ ID NO: 1021 - DNA, 20 bp, Artificial
  B2M gRNA target site sequence
cccgctaagttcgcatgtcc

SEQ ID NO: 1022 - DNA, 20 bp, Artificial
  B2M gRNA target site sequence
ttcgcatgtcctagcacctc

SEQ ID NO: 1023 - DNA, 20 bp, Artificial
  B2M gRNA target site sequence
tcgcatgtcctagcacctct

SEQ ID NO: 1024 - DNA, 20 bp, Artificial
  B2M gRNA target site sequence
ctagcacctctgggtctatg

SEQ ID NO: 1025 - DNA, 20 bp, Artificial
  B2M gRNA target site sequence
tagcacctctgggtctatgt

SEQ ID NO: 1026 - DNA, 20 bp, Artificial
  B2M gRNA target site sequence
agcacctctgggtctatgtg

SEQ ID NO: 1027 - DNA, 20 bp, Artificial
  B2M gRNA target site sequence
gtctatgtggggccacaccg

SEQ ID NO: 1028 - DNA, 20 bp, Artificial
  B2M gRNA target site sequence
tctatgtggggccacaccgt

SEQ ID NO: 1029 - DNA, 20 bp, Artificial
  B2M gRNA target site sequence
ctatgtggggccacaccgtg

SEQ ID NO: 1030 - DNA, 20 bp, Artificial
  B2M gRNA target site sequence
atgtggggccacaccgtggg

SEQ ID NO: 1031 - DNA, 20 bp, Artificial
  B2M gRNA target site sequence
tgtggggccacaccgtgggg

SEQ ID NO: 1032 - DNA, 20 bp, Artificial
  B2M gRNA target site sequence
gccacaccgtggggaggaaa

SEQ ID NO: 1033 - DNA, 20 bp, Artificial
  B2M gRNA target site sequence
gaaacagcacgcgacgtttg

SEQ ID NO: 1034 - DNA, 20 bp, Artificial
  B2M gRNA target site sequence
cgcgacgtttgtagaatgct

SEQ ID NO: 1035 - DNA, 20 bp, Artificial
  B2M gRNA target site sequence
gaatgcttggctgtgataca

SEQ ID NO: 1036 - DNA, 20 bp, Artificial
  B2M gRNA target site sequence
tgcttggctgtgatacaaag

SEQ ID NO: 1037 - DNA, 20 bp, Artificial
  B2M gRNA target site sequence
tgtcacttttaaaaaattat

SEQ ID NO: 1038 - DNA, 20 bp, Artificial
  B2M gRNA target site sequence
ttgacatctttctgtgtgcc

SEQ ID NO: 1039 - DNA, 20 bp, Artificial
  B2M gRNA target site sequence
tgacatctttctgtgtgcca

SEQ ID NO: 1040 - DNA, 20 bp, Artificial
  B2M gRNA target site sequence
gcgtcatttaattttgaaaa

SEQ ID NO: 1041 - DNA, 20 bp, Artificial
  B2M gRNA target site sequence
aaaacagttatcttccgcca

SEQ ID NO: 1042 - DNA, 20 bp, Artificial
  B2M gRNA target site sequence
tccgccatagataactacta

SEQ ID NO: 1043 - DNA, 20 bp, Artificial
  B2M gRNA target site sequence
tggttatcttctgcctctca

SEQ ID NO: 1044 - DNA, 20 bp, Artificial
  B2M gRNA target site sequence
tcttctgcctctcacagatg

SEQ ID NO: 1045 - DNA, 20 bp, Artificial
  B2M gRNA target site sequence
ctctcacagatgaagaaact

SEQ ID NO: 1046 - DNA, 20 bp, Artificial
  B2M gRNA target site sequence
tctcacagatgaagaaacta

SEQ ID NO: 1047 - DNA, 20 bp, Artificial
  B2M gRNA target site sequence
gatgaagaaactaaggcacc

SEQ ID NO: 1048 - DNA, 20 bp, Artificial
  B2M gRNA target site sequence
aactaaggcaccgagatttt

SEQ ID NO: 1049 - DNA, 20 bp, Artificial
  B2M gRNA target site sequence
ttttaagaaacttaattaca

SEQ ID NO: 1050 - DNA, 20 bp, Artificial
  B2M gRNA target site sequence
tttaagaaacttaattacac

SEQ ID NO: 1051 - DNA, 20 bp, Artificial
  B2M gRNA target site sequence
ttaagaaacttaattacaca

SEQ ID NO: 1052 - DNA, 20 bp, Artificial
  B2M gRNA target site sequence
taagaaacttaattacacag

SEQ ID NO: 1053 - DNA, 20 bp, Artificial
  B2M gRNA target site sequence
ttaattacacaggggataaa

SEQ ID NO: 1054 - DNA, 20 bp, Artificial
  B2M gRNA target site sequence
attacacaggggataaatgg

SEQ ID NO: 1055 - DNA, 20 bp, Artificial
  B2M gRNA target site sequence
ggggataaatggcagcaatc

SEQ ID NO: 1056 - DNA, 20 bp, Artificial
  B2M gRNA target site sequence
aatggcagcaatcgagattg

SEQ ID NO: 1057 - DNA, 20 bp, Artificial
  B2M gRNA target site sequence
cagcaatcgagattgaagtc

SEQ ID NO: 1058 - DNA, 20 bp, Artificial
  B2M gRNA target site sequence
agattgaagtcaagcctaac

SEQ ID NO: 1059 - DNA, 20 bp, Artificial
  B2M gRNA target site sequence
gattgaagtcaagcctaacc

SEQ ID NO: 1060 - DNA, 20 bp, Artificial
  B2M gRNA target site sequence
attgaagtcaagcctaacca

SEQ ID NO: 1061 - DNA, 20 bp, Artificial
  B2M gRNA target site sequence
aagcctaaccagggcttttg

SEQ ID NO: 1062 - DNA, 20 bp, Artificial
  B2M gRNA target site sequence
agcctaaccagggcttttgc

SEQ ID NO: 1063 - DNA, 20 bp, Artificial
  B2M gRNA target site sequence
cctaaccagggcttttgcgg

SEQ ID NO: 1064 - DNA, 20 bp, Artificial
  B2M gRNA target site sequence
ttgcgggagcgcatgccttt

SEQ ID NO: 1065 - DNA, 20 bp, Artificial
  B2M gRNA target site sequence
taattcgtgcattttttttt

SEQ ID NO: 1066 - DNA, 20 bp, Artificial
  B2M gRNA target site sequence
aaaacgcctgccttctgcgt

SEQ ID NO: 1067 - DNA, 20 bp, Artificial
  B2M gRNA target site sequence
gccttctgcgtgagattctc

SEQ ID NO: 1068 - DNA, 20 bp, Artificial
  B2M gRNA target site sequence
cttctgcgtgagattctcca

SEQ ID NO: 1069 - DNA, 20 bp, Artificial
  B2M gRNA target site sequence
tgagattctccagagcaaac

SEQ ID NO: 1070 - DNA, 20 bp, Artificial
  B2M gRNA target site sequence
gagattctccagagcaaact

SEQ ID NO: 1071 - DNA, 20 bp, Artificial
  B2M gRNA target site sequence
attctccagagcaaactggg

SEQ ID NO: 1072 - DNA, 20 bp, Artificial
  B2M gRNA target site sequence
ccagagcaaactgggcggca

SEQ ID NO: 1073 - DNA, 20 bp, Artificial
  B2M gRNA target site sequence
cagagcaaactgggcggcat

SEQ ID NO: 1074 - DNA, 20 bp, Artificial
  B2M gRNA target site sequence
actgggcggcatgggccctg

SEQ ID NO: 1075 - DNA, 20 bp, Artificial
  B2M gRNA target site sequence
ggccctgtggtcttttcgta

SEQ ID NO: 1076 - DNA, 20 bp, Artificial
  B2M gRNA target site sequence
ccctgtggtcttttcgtaca

SEQ ID NO: 1077 - DNA, 20 bp, Artificial
  B2M gRNA target site sequence
cctgtggtcttttcgtacag

SEQ ID NO: 1078 - DNA, 20 bp, Artificial
  B2M gRNA target site sequence
ctgtggtcttttcgtacaga

SEQ ID NO: 1079 - DNA, 20 bp, Artificial
  B2M gRNA target site sequence
cgtacagagggcttcctctt

SEQ ID NO: 1080 - DNA, 20 bp, Artificial
  B2M gRNA target site sequence
ttcctctttggctctttgcc

SEQ ID NO: 1081 - DNA, 20 bp, Artificial
  B2M gRNA target site sequence
ctctttgcctggttgtttcc

SEQ ID NO: 1082 - DNA, 20 bp, Artificial
  B2M gRNA target site sequence
tgtactgtgcctcttacttt

SEQ ID NO: 1083 - DNA, 20 bp, Artificial
  B2M gRNA target site sequence
actttcggttttgaaaacat

SEQ ID NO: 1084 - DNA, 20 bp, Artificial
  B2M gRNA target site sequence
ctttcggttttgaaaacatg

SEQ ID NO: 1085 - DNA, 20 bp, Artificial
  B2M gRNA target site sequence
tttcggttttgaaaacatga

SEQ ID NO: 1086 - DNA, 20 bp, Artificial
  B2M gRNA target site sequence
ttcggttttgaaaacatgag

SEQ ID NO: 1087 - DNA, 20 bp, Artificial
  B2M gRNA target site sequence
tcggttttgaaaacatgagg

SEQ ID NO: 1088 - DNA, 20 bp, Artificial
  B2M gRNA target site sequence
ttttgaaaacatgagggggt

SEQ ID NO: 1089 - DNA, 20 bp, Artificial
  B2M gRNA target site sequence
tttgaaaacatgagggggtt

SEQ ID NO: 1090 - DNA, 20 bp, Artificial
  B2M gRNA target site sequence
aaacatgagggggttgggcg

SEQ ID NO: 1091 - DNA, 20 bp, Artificial
  B2M gRNA target site sequence
catgagggggttgggcgtgg

SEQ ID NO: 1092 - DNA, 20 bp, Artificial
  B2M gRNA target site sequence
gtagcttacgcctgtaatcc

SEQ ID NO: 1093 - DNA, 20 bp, Artificial
  B2M gRNA target site sequence
acgcctgtaatcccagcact

SEQ ID NO: 1094 - DNA, 20 bp, Artificial
  B2M gRNA target site sequence
cgcctgtaatcccagcactt

SEQ ID NO: 1095 - DNA, 20 bp, Artificial
  B2M gRNA target site sequence
gcctgtaatcccagcactta

SEQ ID NO: 1096 - DNA, 20 bp, Artificial
  B2M gRNA target site sequence
ctgtaatcccagcacttagg

SEQ ID NO: 1097 - DNA, 20 bp, Artificial
  B2M gRNA target site sequence
tgtaatcccagcacttaggg

SEQ ID NO: 1098 - DNA, 20 bp, Artificial
  B2M gRNA target site sequence
tcccagcacttagggaggcc

SEQ ID NO: 1099 - DNA, 20 bp, Artificial
  B2M gRNA target site sequence
cccagcacttagggaggccg

SEQ ID NO: 1100 - DNA, 20 bp, Artificial
  B2M gRNA target site sequence
agcacttagggaggccgagg

SEQ ID NO: 1101 - DNA, 20 bp, Artificial
  B2M gRNA target site sequence
gcacttagggaggccgaggc

SEQ ID NO: 1102 - DNA, 20 bp, Artificial
  B2M gRNA target site sequence
acttagggaggccgaggcgg

SEQ ID NO: 1103 - DNA, 20 bp, Artificial
  B2M gRNA target site sequence
cttagggaggccgaggcggg

SEQ ID NO: 1104 - DNA, 20 bp, Artificial
  B2M gRNA target site sequence
gggaggccgaggcgggagga

SEQ ID NO: 1105 - DNA, 20 bp, Artificial
  B2M gRNA target site sequence
ccgaggcgggaggatggctt

SEQ ID NO: 1106 - DNA, 20 bp, Artificial
  B2M gRNA target site sequence
cgaggcgggaggatggcttg

SEQ ID NO: 1107 - DNA, 20 bp, Artificial
  B2M gRNA target site sequence
ggaggatggcttgaggtccg

SEQ ID NO: 1108 - DNA, 20 bp, Artificial
  B2M gRNA target site sequence
atggcttgaggtccgtagtt

SEQ ID NO: 1109 - DNA, 20 bp, Artificial
  B2M gRNA target site sequence
ttgaggtccgtagttgagac

SEQ ID NO: 1110 - DNA, 20 bp, Artificial
  B2M gRNA target site sequence
gtccgtagttgagaccagcc

SEQ ID NO: 1111 - DNA, 20 bp, Artificial
  B2M gRNA target site sequence
tgagaccagcctggccaaca

SEQ ID NO: 1112 - DNA, 20 bp, Artificial
  B2M gRNA target site sequence
ccagcctggccaacatggtg

SEQ ID NO: 1113 - DNA, 20 bp, Artificial
  B2M gRNA target site sequence
ctggccaacatggtgaagcc

SEQ ID NO: 1114 - DNA, 20 bp, Artificial
  B2M gRNA target site sequence
caaaaaataataacaaaaat

SEQ ID NO: 1115 - DNA, 20 bp, Artificial
  B2M gRNA target site sequence
aaataataacaaaaattagc

SEQ ID NO: 1116 - DNA, 20 bp, Artificial
  B2M gRNA target site sequence
aataataacaaaaattagcc

SEQ ID NO: 1117 - DNA, 20 bp, Artificial
  B2M gRNA target site sequence
taacaaaaattagccgggtg

SEQ ID NO: 1118 - DNA, 20 bp, Artificial
  B2M gRNA target site sequence
caaaaattagccgggtgtgg

SEQ ID NO: 1119 - DNA, 20 bp, Artificial
  B2M gRNA target site sequence
ggtgtggtggctcgtgcctg

SEQ ID NO: 1120 - DNA, 20 bp, Artificial
  B2M gRNA target site sequence
gtggctcgtgcctgtggtcc

SEQ ID NO: 1121 - DNA, 20 bp, Artificial
  B2M gRNA target site sequence
gcctgtggtcccagctgctc

SEQ ID NO: 1122 - DNA, 20 bp, Artificial
  B2M gRNA target site sequence
tgtggtcccagctgctccgg

SEQ ID NO: 1123 - DNA, 20 bp, Artificial
  B2M gRNA target site sequence
tcccagctgctccggtggct

SEQ ID NO: 1124 - DNA, 20 bp, Artificial
  B2M gRNA target site sequence
cccagctgctccggtggctg

SEQ ID NO: 1125 - DNA, 20 bp, Artificial
  B2M gRNA target site sequence
agctgctccggtggctgagg

SEQ ID NO: 1126 - DNA, 20 bp, Artificial
  B2M gRNA target site sequence
gctgctccggtggctgaggc

SEQ ID NO: 1127 - DNA, 20 bp, Artificial
  B2M gRNA target site sequence
tgctccggtggctgaggcgg

SEQ ID NO: 1128 - DNA, 20 bp, Artificial
  B2M gRNA target site sequence
gctccggtggctgaggcggg

SEQ ID NO: 1129 - DNA, 20 bp, Artificial
  B2M gRNA target site sequence
ctgaggcgggaggatctctt

SEQ ID NO: 1130 - DNA, 20 bp, Artificial
  B2M gRNA target site sequence
gcgggaggatctcttgagct

SEQ ID NO: 1131 - DNA, 20 bp, Artificial
  B2M gRNA target site sequence
cgggaggatctcttgagctt

SEQ ID NO: 1132 - DNA, 20 bp, Artificial
  B2M gRNA target site sequence
tctcttgagcttaggctttt

SEQ ID NO: 1133 - DNA, 20 bp, Artificial
  B2M gRNA target site sequence
cttaggcttttgagctatca

SEQ ID NO: 1134 - DNA, 20 bp, Artificial
  B2M gRNA target site sequence
cttttgagctatcatggcgc

SEQ ID NO: 1135 - DNA, 20 bp, Artificial
  B2M gRNA target site sequence
atcatggcgccagtgcactc

SEQ ID NO: 1136 - DNA, 20 bp, Artificial
  B2M gRNA target site sequence
ggcgccagtgcactccagcg

SEQ ID NO: 1137 - DNA, 20 bp, Artificial
  B2M gRNA target site sequence
gcgccagtgcactccagcgt

SEQ ID NO: 1138 - DNA, 20 bp, Artificial
  B2M gRNA target site sequence
gtgcactccagcgtgggcaa

SEQ ID NO: 1139 - DNA, 20 bp, Artificial
  B2M gRNA target site sequence
gcactccagcgtgggcaaca

SEQ ID NO: 1140 - DNA, 20 bp, Artificial
  B2M gRNA target site sequence
tccagcgtgggcaacagagc

SEQ ID NO: 1141 - DNA, 20 bp, Artificial
  B2M gRNA target site sequence
cgagaccctgtctctcaaaa

SEQ ID NO: 1142 - DNA, 20 bp, Artificial
  B2M gRNA target site sequence
aaaaaagaaaaaaaaaaaaa

SEQ ID NO: 1143 - DNA, 20 bp, Artificial
  B2M gRNA target site sequence
aagaaaaaaaaaaaaaaaga

SEQ ID NO: 1144 - DNA, 20 bp, Artificial
  B2M gRNA target site sequence
gaaaaaaaaaaaaaaagaaa

SEQ ID NO: 1145 - DNA, 20 bp, Artificial
  B2M gRNA target site sequence
aaaaaaaaaaagaaagagaa

SEQ ID NO: 1146 - DNA, 20 bp, Artificial
  B2M gRNA target site sequence
aaaaaagaaagagaaaagaa

SEQ ID NO: 1147 - DNA, 20 bp, Artificial
  B2M gRNA target site sequence
aagaaagagaaaagaaaaga

SEQ ID NO: 1148 - DNA, 20 bp, Artificial
  B2M gRNA target site sequence
aagagaaaagaaaagaaaga

SEQ ID NO: 1149 - DNA, 20 bp, Artificial
  B2M gRNA target site sequence
agaaaagaaaagaaagaaag

SEQ ID NO: 1150 - DNA, 20 bp, Artificial
  B2M gRNA target site sequence
agaaaagaaagaaagaagtg

SEQ ID NO: 1151 - DNA, 20 bp, Artificial
  B2M gRNA target site sequence
gaaaagaaagaaagaagtga

SEQ ID NO: 1152 - DNA, 20 bp, Artificial
  B2M gRNA target site sequence
agaaagaagtgaaggtttgt

SEQ ID NO: 1153 - DNA, 20 bp, Artificial
  B2M gRNA target site sequence
agaagtgaaggtttgtcagt

SEQ ID NO: 1154 - DNA, 20 bp, Artificial
  B2M gRNA target site sequence
gaagtgaaggtttgtcagtc

SEQ ID NO: 1155 - DNA, 20 bp, Artificial
  B2M gRNA target site sequence
aagtgaaggtttgtcagtca

SEQ ID NO: 1156 - DNA, 20 bp, Artificial
  B2M gRNA target site sequence
agtgaaggtttgtcagtcag

SEQ ID NO: 1157 - DNA, 20 bp, Artificial
  B2M gRNA target site sequence
tgaaggtttgtcagtcaggg

SEQ ID NO: 1158 - DNA, 20 bp, Artificial
  B2M gRNA target site sequence
gagctgtaaaaccattaata

SEQ ID NO: 1159 - DNA, 20 bp, Artificial
  B2M gRNA target site sequence
accattaataaagataatcc

SEQ ID NO: 1160 - DNA, 20 bp, Artificial
  B2M gRNA target site sequence
ttaataaagataatccaaga

SEQ ID NO: 1161 - DNA, 20 bp, Artificial
  B2M gRNA target site sequence
gataatccaagatggttacc

SEQ ID NO: 1162 - DNA, 20 bp, Artificial
  B2M gRNA target site sequence
agatggttaccaagactgtt

SEQ ID NO: 1163 - DNA, 20 bp, Artificial
  B2M gRNA target site sequence
gatggttaccaagactgttg

SEQ ID NO: 1164 - DNA, 20 bp, Artificial
  B2M gRNA target site sequence
accaagactgttgaggacgc

SEQ ID NO: 1165 - DNA, 20 bp, Artificial
  B2M gRNA target site sequence
caagactgttgaggacgcca

SEQ ID NO: 1166 - DNA, 20 bp, Artificial
  B2M gRNA target site sequence
ttgaggacgccagagatctt

SEQ ID NO: 1167 - DNA, 20 bp, Artificial
  B2M gRNA target site sequence
agagatcttgagcactttct

SEQ ID NO: 1168 - DNA, 20 bp, Artificial
  B2M gRNA target site sequence
ttgagcactttctaagtacc

SEQ ID NO: 1169 - DNA, 20 bp, Artificial
  B2M gRNA target site sequence
taagtacctggcaatacact

SEQ ID NO: 1170 - DNA, 20 bp, Artificial
  B2M gRNA target site sequence
agcgcgctcaccttttcctc

SEQ ID NO: 1171 - DNA, 20 bp, Artificial
  B2M gRNA target site sequence
ctctggcaaaacatgatcga

SEQ ID NO: 1172 - DNA, 20 bp, Artificial
  B2M gRNA target site sequence
tggcaaaacatgatcgaaag

SEQ ID NO: 1173 - DNA, 20 bp, Artificial
  B2M gRNA target site sequence
aagcagaatgttttgatcat

SEQ ID NO: 1174 - DNA, 20 bp, Artificial
  B2M gRNA target site sequence
tacaatttatttacaacata

SEQ ID NO: 1175 - DNA, 20 bp, Artificial
  B2M gRNA target site sequence
acaatttatttacaacataa

SEQ ID NO: 1176 - DNA, 20 bp, Artificial
  B2M gRNA target site sequence
gtatatatcaccaccattac

SEQ ID NO: 1177 - DNA, 20 bp, Artificial
  B2M gRNA target site sequence
ccaccattactggtatttgc

SEQ ID NO: 1178 - DNA, 20 bp, Artificial
  B2M gRNA target site sequence
ctggtatttgctggttatgt

SEQ ID NO: 1179 - DNA, 20 bp, Artificial
  B2M gRNA target site sequence
tcttattttgaaaatttcca

SEQ ID NO: 1180 - DNA, 20 bp, Artificial
  B2M gRNA target site sequence
aaagtaatacatgccatgca

SEQ ID NO: 1181 - DNA, 20 bp, Artificial
  B2M gRNA target site sequence
tgccatgcatagaccatttc

SEQ ID NO: 1182 - DNA, 20 bp, Artificial
  B2M gRNA target site sequence
catgcatagaccatttctgg

SEQ ID NO: 1183 - DNA, 20 bp, Artificial
  B2M gRNA target site sequence
ccatttctggaagataccac

SEQ ID NO: 1184 - DNA, 20 bp, Artificial
  B2M gRNA target site sequence
tgtaatgatgattgcctctg

SEQ ID NO: 1185 - DNA, 20 bp, Artificial
  B2M gRNA target site sequence
gtaatgatgattgcctctga

SEQ ID NO: 1186 - DNA, 20 bp, Artificial
  B2M gRNA target site sequence
ttcctcctctgacctgtgtg

SEQ ID NO: 1187 - DNA, 20 bp, Artificial
  B2M gRNA target site sequence
tcctcctctgacctgtgtgt

SEQ ID NO: 1188 - DNA, 20 bp, Artificial
  B2M gRNA target site sequence
gttttgtttttgttttactg

SEQ ID NO: 1189 - DNA, 20 bp, Artificial
  B2M gRNA target site sequence
ttttgtttttgttttactgt

SEQ ID NO: 1190 - DNA, 20 bp, Artificial
  B2M gRNA target site sequence
gtgggcataaattaattttt

SEQ ID NO: 1191 - DNA, 20 bp, Artificial
  B2M gRNA target site sequence
cataaattaatttttcagtt

SEQ ID NO: 1192 - DNA, 20 bp, Artificial
  B2M gRNA target site sequence
ttaatttttcagttaagttt

SEQ ID NO: 1193 - DNA, 20 bp, Artificial
  B2M gRNA target site sequence
atttttcagttaagttttgg

SEQ ID NO: 1194 - DNA, 20 bp, Artificial
  B2M gRNA target site sequence
aagcttaaataactctccaa

SEQ ID NO: 1195 - DNA, 20 bp, Artificial
  B2M gRNA target site sequence
ataactctccaaaagtcata

SEQ ID NO: 1196 - DNA, 20 bp, Artificial
  B2M gRNA target site sequence
ctctccaaaagtcataaagc

SEQ ID NO: 1197 - DNA, 20 bp, Artificial
  B2M gRNA target site sequence
aaagtcataaagccagtaac

SEQ ID NO: 1198 - DNA, 20 bp, Artificial
  B2M gRNA target site sequence
cataaagccagtaactggtt

SEQ ID NO: 1199 - DNA, 20 bp, Artificial
  B2M gRNA target site sequence
gttgagcccaaattcaaacc

SEQ ID NO: 1200 - DNA, 20 bp, Artificial
  B2M gRNA target site sequence
tctgatacttgtcctcttct

SEQ ID NO: 1201 - DNA, 20 bp, Artificial
  B2M gRNA target site sequence
tacttgtcctcttcttagaa

SEQ ID NO: 1202 - DNA, 20 bp, Artificial
  B2M gRNA target site sequence
cctcttcttagaaaagatta

SEQ ID NO: 1203 - DNA, 20 bp, Artificial
  B2M gRNA target site sequence
tcttgccgccttccctcaaa

SEQ ID NO: 1204 - DNA, 20 bp, Artificial
  B2M gRNA target site sequence
ttgccgccttccctcaaaca

SEQ ID NO: 1205 - DNA, 20 bp, Artificial
  B2M gRNA target site sequence
gccgccttccctcaaacaga

SEQ ID NO: 1206 - DNA, 20 bp, Artificial
  B2M gRNA target site sequence
ttccctcaaacagagagttc

SEQ ID NO: 1207 - DNA, 20 bp, Artificial
  B2M gRNA target site sequence
tccctcaaacagagagttcc

SEQ ID NO: 1208 - DNA, 20 bp, Artificial
  B2M gRNA target site sequence
ctcaaacagagagttccagg

SEQ ID NO: 1209 - DNA, 20 bp, Artificial
  B2M gRNA target site sequence
tcaaacagagagttccaggc

SEQ ID NO: 1210 - DNA, 20 bp, Artificial
  B2M gRNA target site sequence
gaatctgtgctctgatccct

SEQ ID NO: 1211 - DNA, 20 bp, Artificial
  B2M gRNA target site sequence
aatctgtgctctgatccctg

SEQ ID NO: 1212 - DNA, 20 bp, Artificial
  B2M gRNA target site sequence
atttaatatgttcttattat

SEQ ID NO: 1213 - DNA, 20 bp, Artificial
  B2M gRNA target site sequence
taatatgttcttattattag

SEQ ID NO: 1214 - DNA, 20 bp, Artificial
  B2M gRNA target site sequence
tgttcttattattagaagct

SEQ ID NO: 1215 - DNA, 20 bp, Artificial
  B2M gRNA target site sequence
ttattagaagctcagatgca

SEQ ID NO: 1216 - DNA, 20 bp, Artificial
  B2M gRNA target site sequence
attagaagctcagatgcaaa

SEQ ID NO: 1217 - DNA, 20 bp, Artificial
  B2M gRNA target site sequence
tcagatgcaaagagctctct

SEQ ID NO: 1218 - DNA, 20 bp, Artificial
  B2M gRNA target site sequence
tttaatgttatgaaaaaaat

SEQ ID NO: 1219 - DNA, 20 bp, Artificial
  B2M gRNA target site sequence
ttaatgttatgaaaaaaatc

SEQ ID NO: 1220 - DNA, 20 bp, Artificial
  B2M gRNA target site sequence
gaaaaaaatcaggtcttcat

SEQ ID NO: 1221 - DNA, 20 bp, Artificial
  B2M gRNA target site sequence
ttccccaatccacctcttga

SEQ ID NO: 1222 - DNA, 20 bp, Artificial
  B2M gRNA target site sequence
tccccaatccacctcttgat

SEQ ID NO: 1223 - DNA, 20 bp, Artificial
  B2M gRNA target site sequence
ccccaatccacctcttgatg

SEQ ID NO: 1224 - DNA, 20 bp, Artificial
  B2M gRNA target site sequence
aatccacctcttgatggggc

SEQ ID NO: 1225 - DNA, 20 bp, Artificial
  B2M gRNA target site sequence
ccacctcttgatggggctag

SEQ ID NO: 1226 - DNA, 20 bp, Artificial
  B2M gRNA target site sequence
tagtagcctttccttaatga

SEQ ID NO: 1227 - DNA, 20 bp, Artificial
  B2M gRNA target site sequence
agtagcctttccttaatgat

SEQ ID NO: 1228 - DNA, 20 bp, Artificial
  B2M gRNA target site sequence
gtagcctttccttaatgata

SEQ ID NO: 1229 - DNA, 20 bp, Artificial
  B2M gRNA target site sequence
ccttaatgatagggtgtttc

SEQ ID NO: 1230 - DNA, 20 bp, Artificial
  B2M gRNA target site sequence
ttaatgatagggtgtttcta

SEQ ID NO: 1231 - DNA, 20 bp, Artificial
  B2M gRNA target site sequence
aatgatagggtgtttctaga

SEQ ID NO: 1232 - DNA, 20 bp, Artificial
  B2M gRNA target site sequence
tgtttctagagagatatatc

SEQ ID NO: 1233 - DNA, 20 bp, Artificial
  B2M gRNA target site sequence
ctagagagatatatctggtc

SEQ ID NO: 1234 - DNA, 20 bp, Artificial
  B2M gRNA target site sequence
tagagagatatatctggtca

SEQ ID NO: 1235 - DNA, 20 bp, Artificial
  B2M gRNA target site sequence
agagatatatctggtcaagg

SEQ ID NO: 1236 - DNA, 20 bp, Artificial
  B2M gRNA target site sequence
tatatctggtcaaggtggcc

SEQ ID NO: 1237 - DNA, 20 bp, Artificial
  B2M gRNA target site sequence
ggtactcctccttctcccca

SEQ ID NO: 1238 - DNA, 20 bp, Artificial
  B2M gRNA target site sequence
tccttctccccacagcctcc

SEQ ID NO: 1239 - DNA, 20 bp, Artificial
  B2M gRNA target site sequence
ctccccacagcctcccagac

SEQ ID NO: 1240 - DNA, 20 bp, Artificial
  B2M gRNA target site sequence
tccccacagcctcccagaca

SEQ ID NO: 1241 - DNA, 20 bp, Artificial
  B2M gRNA target site sequence
cccacagcctcccagacaag

SEQ ID NO: 1242 - DNA, 20 bp, Artificial
  B2M gRNA target site sequence
ccacagcctcccagacaagg

SEQ ID NO: 1243 - DNA, 20 bp, Artificial
  B2M gRNA target site sequence
acagcctcccagacaaggag

SEQ ID NO: 1244 - DNA, 20 bp, Artificial
  B2M gRNA target site sequence
gcctcccagacaaggaggag

SEQ ID NO: 1245 - DNA, 20 bp, Artificial
  B2M gRNA target site sequence
aaggaggagtagctgccttt

SEQ ID NO: 1246 - DNA, 20 bp, Artificial
  B2M gRNA target site sequence
tgatcatgtaccctgaatat

SEQ ID NO: 1247 - DNA, 20 bp, Artificial
  B2M gRNA target site sequence
ctgaatataagtgtatttaa

SEQ ID NO: 1248 - DNA, 20 bp, Artificial
  B2M gRNA target site sequence
gaattttatacacatatatt

SEQ ID NO: 1249 - DNA, 20 bp, Artificial
  B2M gRNA target site sequence
ttagtgtcaatctgtatatt

SEQ ID NO: 1250 - DNA, 20 bp, Artificial
  B2M gRNA target site sequence
gtgtcaatctgtatatttag

SEQ ID NO: 1251 - DNA, 20 bp, Artificial
  B2M gRNA target site sequence
ttcattttcaatgaaaaata

SEQ ID NO: 1252 - DNA, 20 bp, Artificial
  B2M gRNA target site sequence
cattttcaatgaaaaatata

SEQ ID NO: 1253 - DNA, 20 bp, Artificial
  B2M gRNA target site sequence
attttcttcccacttcccca

SEQ ID NO: 1254 - DNA, 20 bp, Artificial
  B2M gRNA target site sequence
tcttcccacttccccatgga

SEQ ID NO: 1255 - DNA, 20 bp, Artificial
  B2M gRNA target site sequence
ccacttccccatggatggtc

SEQ ID NO: 1256 - DNA, 20 bp, Artificial
  B2M gRNA target site sequence
tctagtcatgcctctcattt

SEQ ID NO: 1257 - DNA, 20 bp, Artificial
  B2M gRNA target site sequence
gtcatgcctctcattttgga

SEQ ID NO: 1258 - DNA, 20 bp, Artificial
  B2M gRNA target site sequence
aagtactgtttctgaaacat

SEQ ID NO: 1259 - DNA, 20 bp, Artificial
  B2M gRNA target site sequence
agtactgtttctgaaacatt

SEQ ID NO: 1260 - DNA, 20 bp, Artificial
  B2M gRNA target site sequence
taggcaatatattcccaacc

SEQ ID NO: 1261 - DNA, 20 bp, Artificial
  B2M gRNA target site sequence
caatatattcccaacctggc

SEQ ID NO: 1262 - DNA, 20 bp, Artificial
  B2M gRNA target site sequence
ttcccaacctggctagttta

SEQ ID NO: 1263 - DNA, 20 bp, Artificial
  B2M gRNA target site sequence
tagtttacagcaatcacctg

SEQ ID NO: 1264 - DNA, 20 bp, Artificial
  B2M gRNA target site sequence
attactccatttgatcataa

SEQ ID NO: 1265 - DNA, 20 bp, Artificial
  B2M gRNA target site sequence
ctccatttgatcataatgga

SEQ ID NO: 1266 - DNA, 20 bp, Artificial
  B2M gRNA target site sequence
atgttctgtcccatttgcca

SEQ ID NO: 1267 - DNA, 20 bp, Artificial
  B2M gRNA target site sequence
ctatccctgttgtattttat

SEQ ID NO: 1268 - DNA, 20 bp, Artificial
  B2M gRNA target site sequence
tatccctgttgtattttatc

SEQ ID NO: 1269 - DNA, 20 bp, Artificial
  B2M gRNA target site sequence
cgggtccaactcaaccattt

SEQ ID NO: 1270 - DNA, 20 bp, Artificial
  B2M gRNA target site sequence
gggtccaactcaaccattta

SEQ ID NO: 1271 - DNA, 20 bp, Artificial
  B2M gRNA target site sequence
caaccatttaaggtatttgc

SEQ ID NO: 1272 - DNA, 20 bp, Artificial
  B2M gRNA target site sequence
tgccagctcttgtatgcatt

SEQ ID NO: 1273 - DNA, 20 bp, Artificial
  B2M gRNA target site sequence
gccagctcttgtatgcattt

SEQ ID NO: 1274 - DNA, 20 bp, Artificial
  B2M gRNA target site sequence
ggttttgtttctttgttttt

SEQ ID NO: 1275 - DNA, 20 bp, Artificial
  B2M gRNA target site sequence
tgttttttagctcatgaaat

SEQ ID NO: 1276 - DNA, 20 bp, Artificial
  B2M gRNA target site sequence
gttttttagctcatgaaatt

SEQ ID NO: 1277 - DNA, 20 bp, Artificial
  B2M gRNA target site sequence
agctcatgaaattaggtaca

SEQ ID NO: 1278 - DNA, 20 bp, Artificial
  B2M gRNA target site sequence
catgaaattaggtacaaagt

SEQ ID NO: 1279 - DNA, 20 bp, Artificial
  B2M gRNA target site sequence
tgaaattaggtacaaagtca

SEQ ID NO: 1280 - DNA, 20 bp, Artificial
  B2M gRNA target site sequence
aaattaggtacaaagtcaga

SEQ ID NO: 1281 - DNA, 20 bp, Artificial
  B2M gRNA target site sequence
aattaggtacaaagtcagag

SEQ ID NO: 1282 - DNA, 20 bp, Artificial
  B2M gRNA target site sequence
attaggtacaaagtcagaga

SEQ ID NO: 1283 - DNA, 20 bp, Artificial
  B2M gRNA target site sequence
ttaggtacaaagtcagagag

SEQ ID NO: 1284 - DNA, 20 bp, Artificial
  B2M gRNA target site sequence
tacaaagtcagagaggggtc

SEQ ID NO: 1285 - DNA, 20 bp, Artificial
  B2M gRNA target site sequence
gggtctggcatataaaacct

SEQ ID NO: 1286 - DNA, 20 bp, Artificial
  B2M gRNA target site sequence
tctggcatataaaacctcag

SEQ ID NO: 1287 - DNA, 20 bp, Artificial
  B2M gRNA target site sequence
ataaaacctcagcagaaata

SEQ ID NO: 1288 - DNA, 20 bp, Artificial
  B2M gRNA target site sequence
aaaacctcagcagaaataaa

SEQ ID NO: 1289 - DNA, 20 bp, Artificial
  B2M gRNA target site sequence
aaacctcagcagaaataaag

SEQ ID NO: 1290 - DNA, 20 bp, Artificial
  B2M gRNA target site sequence
aataaagaggttttgttgtt

SEQ ID NO: 1291 - DNA, 20 bp, Artificial
  B2M gRNA target site sequence
aagaggttttgttgtttggt

SEQ ID NO: 1292 - DNA, 20 bp, Artificial
  B2M gRNA target site sequence
tgtttggtaagaacatacct

SEQ ID NO: 1293 - DNA, 20 bp, Artificial
  B2M gRNA target site sequence
gtttggtaagaacatacctt

SEQ ID NO: 1294 - DNA, 20 bp, Artificial
  B2M gRNA target site sequence
ggtaagaacataccttgggt

SEQ ID NO: 1295 - DNA, 20 bp, Artificial
  B2M gRNA target site sequence
agaacataccttgggttggt

SEQ ID NO: 1296 - DNA, 20 bp, Artificial
  B2M gRNA target site sequence
gaacataccttgggttggtt

SEQ ID NO: 1297 - DNA, 20 bp, Artificial
  B2M gRNA target site sequence
taccttgggttggttgggca

SEQ ID NO: 1298 - DNA, 20 bp, Artificial
  B2M gRNA target site sequence
cttgggttggttgggcacgg

SEQ ID NO: 1299 - DNA, 20 bp, Artificial
  B2M gRNA target site sequence
tgcctgtaatcccaacactt

SEQ ID NO: 1300 - DNA, 20 bp, Artificial
  B2M gRNA target site sequence
gcctgtaatcccaacacttt

SEQ ID NO: 1301 - DNA, 20 bp, Artificial
  B2M gRNA target site sequence
ctgtaatcccaacactttgg

SEQ ID NO: 1302 - DNA, 20 bp, Artificial
  B2M gRNA target site sequence
tgtaatcccaacactttggg

SEQ ID NO: 1303 - DNA, 20 bp, Artificial
  B2M gRNA target site sequence
tcccaacactttgggaggcc

SEQ ID NO: 1304 - DNA, 20 bp, Artificial
  B2M gRNA target site sequence
cccaacactttgggaggcca

SEQ ID NO: 1305 - DNA, 20 bp, Artificial
  B2M gRNA target site sequence
aacactttgggaggccaagg

SEQ ID NO: 1306 - DNA, 20 bp, Artificial
  B2M gRNA target site sequence
acactttgggaggccaaggc

SEQ ID NO: 1307 - DNA, 20 bp, Artificial
  B2M gRNA target site sequence
caaggcaggctgatcacttg

SEQ ID NO: 1308 - DNA, 20 bp, Artificial
  B2M gRNA target site sequence
gcaggctgatcacttgaagt

SEQ ID NO: 1309 - DNA, 20 bp, Artificial
  B2M gRNA target site sequence
caggctgatcacttgaagtt

SEQ ID NO: 1310 - DNA, 20 bp, Artificial
  B2M gRNA target site sequence
ggctgatcacttgaagttgg

SEQ ID NO: 1311 - DNA, 20 bp, Artificial
  B2M gRNA target site sequence
tcacttgaagttgggagttc

SEQ ID NO: 1312 - DNA, 20 bp, Artificial
  B2M gRNA target site sequence
tgaagttgggagttcaagac

SEQ ID NO: 1313 - DNA, 20 bp, Artificial
  B2M gRNA target site sequence
ttgggagttcaagaccagcc

SEQ ID NO: 1314 - DNA, 20 bp, Artificial
  B2M gRNA target site sequence
caagaccagcctggccaaca

SEQ ID NO: 1315 - DNA, 20 bp, Artificial
  B2M gRNA target site sequence
ctgaaaatacaaaaattaac

SEQ ID NO: 1316 - DNA, 20 bp, Artificial
  B2M gRNA target site sequence
tgaaaatacaaaaattaacc

SEQ ID NO: 1317 - DNA, 20 bp, Artificial
  B2M gRNA target site sequence
atacaaaaattaaccaggca

SEQ ID NO: 1318 - DNA, 20 bp, Artificial
  B2M gRNA target site sequence
caaaaattaaccaggcatgg

SEQ ID NO: 1319 - DNA, 20 bp, Artificial
  B2M gRNA target site sequence
ggcatggtggtgtgtgcctg

SEQ ID NO: 1320 - DNA, 20 bp, Artificial
  B2M gRNA target site sequence
gtggtgtgtgcctgtagtcc

SEQ ID NO: 1321 - DNA, 20 bp, Artificial
  B2M gRNA target site sequence
tggtgtgtgcctgtagtccc

SEQ ID NO: 1322 - DNA, 20 bp, Artificial
  B2M gRNA target site sequence
tcccaggaatcacttgaacc

SEQ ID NO: 1323 - DNA, 20 bp, Artificial
  B2M gRNA target site sequence
cccaggaatcacttgaaccc

SEQ ID NO: 1324 - DNA, 20 bp, Artificial
  B2M gRNA target site sequence
caggaatcacttgaacccag

SEQ ID NO: 1325 - DNA, 20 bp, Artificial
  B2M gRNA target site sequence
aggaatcacttgaacccagg

SEQ ID NO: 1326 - DNA, 20 bp, Artificial
  B2M gRNA target site sequence
aatcacttgaacccaggagg

SEQ ID NO: 1327 - DNA, 20 bp, Artificial
  B2M gRNA target site sequence
tcacttgaacccaggaggcg

SEQ ID NO: 1328 - DNA, 20 bp, Artificial
  B2M gRNA target site sequence
cacttgaacccaggaggcgg

SEQ ID NO: 1329 - DNA, 20 bp, Artificial
  B2M gRNA target site sequence
aacccaggaggcggaggttg

SEQ ID NO: 1330 - DNA, 20 bp, Artificial
  B2M gRNA target site sequence
caggaggcggaggttgcagt

SEQ ID NO: 1331 - DNA, 20 bp, Artificial
  B2M gRNA target site sequence
ggcggaggttgcagtgagct

SEQ ID NO: 1332 - DNA, 20 bp, Artificial
  B2M gRNA target site sequence
caccactgcacactgcactc

SEQ ID NO: 1333 - DNA, 20 bp, Artificial
  B2M gRNA target site sequence
ctgcacactgcactccagcc

SEQ ID NO: 1334 - DNA, 20 bp, Artificial
  B2M gRNA target site sequence
tgcacactgcactccagcct

SEQ ID NO: 1335 - DNA, 20 bp, Artificial
  B2M gRNA target site sequence
ctgcactccagcctgggcaa

SEQ ID NO: 1336 - DNA, 20 bp, Artificial
  B2M gRNA target site sequence
tccagcctgggcaatggaat

SEQ ID NO: 1337 - DNA, 20 bp, Artificial
  B2M gRNA target site sequence
aataaaaaaataaaaaaata

SEQ ID NO: 1338 - DNA, 20 bp, Artificial
  B2M gRNA target site sequence
aaaaaataaagaacatacct

SEQ ID NO: 1339 - DNA, 20 bp, Artificial
  B2M gRNA target site sequence
aaaaataaagaacatacctt

SEQ ID NO: 1340 - DNA, 20 bp, Artificial
  B2M gRNA target site sequence
ataccttgggttgatccact

SEQ ID NO: 1341 - DNA, 20 bp, Artificial
  B2M gRNA target site sequence
taccttgggttgatccactt

SEQ ID NO: 1342 - DNA, 20 bp, Artificial
  B2M gRNA target site sequence
gttgatccacttaggaacct

SEQ ID NO: 1343 - DNA, 20 bp, Artificial
  B2M gRNA target site sequence
ataataacatctgccacgta

SEQ ID NO: 1344 - DNA, 20 bp, Artificial
  B2M gRNA target site sequence
aataacatctgccacgtata

SEQ ID NO: 1345 - DNA, 20 bp, Artificial
  B2M gRNA target site sequence
atagagcaattgctatgtcc

SEQ ID NO: 1346 - DNA, 20 bp, Artificial
  B2M gRNA target site sequence
tagagcaattgctatgtccc

SEQ ID NO: 1347 - DNA, 20 bp, Artificial
  B2M gRNA target site sequence
ctatgtcccaggcactctac

SEQ ID NO: 1348 - DNA, 20 bp, Artificial
  B2M gRNA target site sequence
actctactagacacttcata

SEQ ID NO: 1349 - DNA, 20 bp, Artificial
  B2M gRNA target site sequence
actagacacttcatacagtt

SEQ ID NO: 1350 - DNA, 20 bp, Artificial
  B2M gRNA target site sequence
cttcatacagtttagaaaat

SEQ ID NO: 1351 - DNA, 20 bp, Artificial
  B2M gRNA target site sequence
atacagtttagaaaatcaga

SEQ ID NO: 1352 - DNA, 20 bp, Artificial
  B2M gRNA target site sequence
tacagtttagaaaatcagat

SEQ ID NO: 1353 - DNA, 20 bp, Artificial
  B2M gRNA target site sequence
tttagaaaatcagatgggtg

SEQ ID NO: 1354 - DNA, 20 bp, Artificial
  B2M gRNA target site sequence
aaatcagatgggtgtagatc

SEQ ID NO: 1355 - DNA, 20 bp, Artificial
  B2M gRNA target site sequence
aatcagatgggtgtagatca

SEQ ID NO: 1356 - DNA, 20 bp, Artificial
  B2M gRNA target site sequence
cagatgggtgtagatcaagg

SEQ ID NO: 1357 - DNA, 20 bp, Artificial
  B2M gRNA target site sequence
agatgggtgtagatcaaggc

SEQ ID NO: 1358 - DNA, 20 bp, Artificial
  B2M gRNA target site sequence
atgggtgtagatcaaggcag

SEQ ID NO: 1359 - DNA, 20 bp, Artificial
  B2M gRNA target site sequence
ggtgtagatcaaggcaggag

SEQ ID NO: 1360 - DNA, 20 bp, Artificial
  B2M gRNA target site sequence
gtgtagatcaaggcaggagc

SEQ ID NO: 1361 - DNA, 20 bp, Artificial
  B2M gRNA target site sequence
aggcaggagcaggaaccaaa

SEQ ID NO: 1362 - DNA, 20 bp, Artificial
  B2M gRNA target site sequence
aggagcaggaaccaaaaaga

SEQ ID NO: 1363 - DNA, 20 bp, Artificial
  B2M gRNA target site sequence
ggagcaggaaccaaaaagaa

SEQ ID NO: 1364 - DNA, 20 bp, Artificial
  B2M gRNA target site sequence
aaaaagaaaggcataaacat

SEQ ID NO: 1365 - DNA, 20 bp, Artificial
  B2M gRNA target site sequence
cataaacataagaaaaaaaa

SEQ ID NO: 1366 - DNA, 20 bp, Artificial
  B2M gRNA target site sequence
aaacataagaaaaaaaatgg

SEQ ID NO: 1367 - DNA, 20 bp, Artificial
  B2M gRNA target site sequence
aacataagaaaaaaaatgga

SEQ ID NO: 1368 - DNA, 20 bp, Artificial
  B2M gRNA target site sequence
acataagaaaaaaaatggaa

SEQ ID NO: 1369 - DNA, 20 bp, Artificial
  B2M gRNA target site sequence
cataagaaaaaaaatggaag

SEQ ID NO: 1370 - DNA, 20 bp, Artificial
  B2M gRNA target site sequence
aagaaaaaaaatggaagggg

SEQ ID NO: 1371 - DNA, 20 bp, Artificial
  B2M gRNA target site sequence
aaaaatggaaggggtggaaa

SEQ ID NO: 1372 - DNA, 20 bp, Artificial
  B2M gRNA target site sequence
aaatggaaggggtggaaaca

SEQ ID NO: 1373 - DNA, 20 bp, Artificial
  B2M gRNA target site sequence
gaaacagagtacaataacat

SEQ ID NO: 1374 - DNA, 20 bp, Artificial
  B2M gRNA target site sequence
caataacatgagtaatttga

SEQ ID NO: 1375 - DNA, 20 bp, Artificial
  B2M gRNA target site sequence
aataacatgagtaatttgat

SEQ ID NO: 1376 - DNA, 20 bp, Artificial
  B2M gRNA target site sequence
ataacatgagtaatttgatg

SEQ ID NO: 1377 - DNA, 20 bp, Artificial
  B2M gRNA target site sequence
taacatgagtaatttgatgg

SEQ ID NO: 1378 - DNA, 20 bp, Artificial
  B2M gRNA target site sequence
gatgggggctattatgaact

SEQ ID NO: 1379 - DNA, 20 bp, Artificial
  B2M gRNA target site sequence
actgagaaatgaactttgaa

SEQ ID NO: 1380 - DNA, 20 bp, Artificial
  B2M gRNA target site sequence
atgaactttgaaaagtatct

SEQ ID NO: 1381 - DNA, 20 bp, Artificial
  B2M gRNA target site sequence
tgaactttgaaaagtatctt

SEQ ID NO: 1382 - DNA, 20 bp, Artificial
  B2M gRNA target site sequence
gaactttgaaaagtatcttg

SEQ ID NO: 1383 - DNA, 20 bp, Artificial
  B2M gRNA target site sequence
tatcttggggccaaatcatg

SEQ ID NO: 1384 - DNA, 20 bp, Artificial
  B2M gRNA target site sequence
gccaaatcatgtagactctt

SEQ ID NO: 1385 - DNA, 20 bp, Artificial
  B2M gRNA target site sequence
agactcttgagtgatgtgtt

SEQ ID NO: 1386 - DNA, 20 bp, Artificial
  B2M gRNA target site sequence
gactcttgagtgatgtgtta

SEQ ID NO: 1387 - DNA, 20 bp, Artificial
  B2M gRNA target site sequence
gatgtgttaaggaatgctat

SEQ ID NO: 1388 - DNA, 20 bp, Artificial
  B2M gRNA target site sequence
taaggaatgctatgagtgct

SEQ ID NO: 1389 - DNA, 20 bp, Artificial
  B2M gRNA target site sequence
aggaatgctatgagtgctga

SEQ ID NO: 1390 - DNA, 20 bp, Artificial
  B2M gRNA target site sequence
ggaatgctatgagtgctgag

SEQ ID NO: 1391 - DNA, 20 bp, Artificial
  B2M gRNA target site sequence
gaatgctatgagtgctgaga

SEQ ID NO: 1392 - DNA, 20 bp, Artificial
  B2M gRNA target site sequence
tatgagtgctgagagggcat

SEQ ID NO: 1393 - DNA, 20 bp, Artificial
  B2M gRNA target site sequence
gagtgctgagagggcatcag

SEQ ID NO: 1394 - DNA, 20 bp, Artificial
  B2M gRNA target site sequence
agagggcatcagaagtcctt

SEQ ID NO: 1395 - DNA, 20 bp, Artificial
  B2M gRNA target site sequence
agggcatcagaagtccttga

SEQ ID NO: 1396 - DNA, 20 bp, Artificial
  B2M gRNA target site sequence
cagaagtccttgagagcctc

SEQ ID NO: 1397 - DNA, 20 bp, Artificial
  B2M gRNA target site sequence
gaagtccttgagagcctcca

SEQ ID NO: 1398 - DNA, 20 bp, Artificial
  B2M gRNA target site sequence
tccttgagagcctccagaga

SEQ ID NO: 1399 - DNA, 20 bp, Artificial
  B2M gRNA target site sequence
ccttgagagcctccagagaa

SEQ ID NO: 1400 - DNA, 20 bp, Artificial
  B2M gRNA target site sequence
gagaaaggctcttaaaaatg

SEQ ID NO: 1401 - DNA, 20 bp, Artificial
  B2M gRNA target site sequence
taaaaatgcagcgcaatctc

SEQ ID NO: 1402 - DNA, 20 bp, Artificial
  B2M gRNA target site sequence
tgcagcgcaatctccagtga

SEQ ID NO: 1403 - DNA, 20 bp, Artificial
  B2M gRNA target site sequence
agcgcaatctccagtgacag

SEQ ID NO: 1404 - DNA, 20 bp, Artificial
  B2M gRNA target site sequence
ccagtgacagaagatactgc

SEQ ID NO: 1405 - DNA, 20 bp, Artificial
  B2M gRNA target site sequence
agatactgctagaaatctgc

SEQ ID NO: 1406 - DNA, 20 bp, Artificial
  B2M gRNA target site sequence
ctgctagaaaaaaaacaaaa

SEQ ID NO: 1407 - DNA, 20 bp, Artificial
  B2M gRNA target site sequence
tgctagaaaaaaaacaaaaa

SEQ ID NO: 1408 - DNA, 20 bp, Artificial
  B2M gRNA target site sequence
aaaaacaaaaaaggcatgta

SEQ ID NO: 1409 - DNA, 20 bp, Artificial
  B2M gRNA target site sequence
aaacaaaaaaggcatgtata

SEQ ID NO: 1410 - DNA, 20 bp, Artificial
  B2M gRNA target site sequence
aacaaaaaaggcatgtatag

SEQ ID NO: 1411 - DNA, 20 bp, Artificial
  B2M gRNA target site sequence
ggcatgtatagaggaattat

SEQ ID NO: 1412 - DNA, 20 bp, Artificial
  B2M gRNA target site sequence
gcatgtatagaggaattatg

SEQ ID NO: 1413 - DNA, 20 bp, Artificial
  B2M gRNA target site sequence
catgtatagaggaattatga

SEQ ID NO: 1414 - DNA, 20 bp, Artificial
  B2M gRNA target site sequence
tatagaggaattatgaggga

SEQ ID NO: 1415 - DNA, 20 bp, Artificial
  B2M gRNA target site sequence
aattatgagggaaagatacc

SEQ ID NO: 1416 - DNA, 20 bp, Artificial
  B2M gRNA target site sequence
gagggaaagataccaagtca

SEQ ID NO: 1417 - DNA, 20 bp, Artificial
  B2M gRNA target site sequence
tcacggtttattcttcaaaa

SEQ ID NO: 1418 - DNA, 20 bp, Artificial
  B2M gRNA target site sequence
acggtttattcttcaaaatg

SEQ ID NO: 1419 - DNA, 20 bp, Artificial
  B2M gRNA target site sequence
cggtttattcttcaaaatgg

SEQ ID NO: 1420 - DNA, 20 bp, Artificial
  B2M gRNA target site sequence
tttattcttcaaaatggagg

SEQ ID NO: 1421 - DNA, 20 bp, Artificial
  B2M gRNA target site sequence
tcaaaatggaggtggcttgt

SEQ ID NO: 1422 - DNA, 20 bp, Artificial
  B2M gRNA target site sequence
caaaatggaggtggcttgtt

SEQ ID NO: 1423 - DNA, 20 bp, Artificial
  B2M gRNA target site sequence
aatggaggtggcttgttggg

SEQ ID NO: 1424 - DNA, 20 bp, Artificial
  B2M gRNA target site sequence
atggaggtggcttgttggga

SEQ ID NO: 1425 - DNA, 20 bp, Artificial
  B2M gRNA target site sequence
gaggtggcttgttgggaagg

SEQ ID NO: 1426 - DNA, 20 bp, Artificial
  B2M gRNA target site sequence
gtggcttgttgggaaggtgg

SEQ ID NO: 1427 - DNA, 20 bp, Artificial
  B2M gRNA target site sequence
tgggaaggtggaagctcatt

SEQ ID NO: 1428 - DNA, 20 bp, Artificial
  B2M gRNA target site sequence
aaggtggaagctcatttggc

SEQ ID NO: 1429 - DNA, 20 bp, Artificial
  B2M gRNA target site sequence
ggtggaagctcatttggcca

SEQ ID NO: 1430 - DNA, 20 bp, Artificial
  B2M gRNA target site sequence
ggaagctcatttggccagag

SEQ ID NO: 1431 - DNA, 20 bp, Artificial
  B2M gRNA target site sequence
tcatttggccagagtggaaa

SEQ ID NO: 1432 - DNA, 20 bp, Artificial
  B2M gRNA target site sequence
ggccagagtggaaatggaat

SEQ ID NO: 1433 - DNA, 20 bp, Artificial
  B2M gRNA target site sequence
gccagagtggaaatggaatt

SEQ ID NO: 1434 - DNA, 20 bp, Artificial
  B2M gRNA target site sequence
cagagtggaaatggaattgg

SEQ ID NO: 1435 - DNA, 20 bp, Artificial
  B2M gRNA target site sequence
gatgaccaaatgtaaacact

SEQ ID NO: 1436 - DNA, 20 bp, Artificial
  B2M gRNA target site sequence
taaacacttggtgcctgata

SEQ ID NO: 1437 - DNA, 20 bp, Artificial
  B2M gRNA target site sequence
gcctgatatagcttgacacc

SEQ ID NO: 1438 - DNA, 20 bp, Artificial
  B2M gRNA target site sequence
gatatagcttgacaccaagt

SEQ ID NO: 1439 - DNA, 20 bp, Artificial
  B2M gRNA target site sequence
cttgacaccaagttagcccc

SEQ ID NO: 1440 - DNA, 20 bp, Artificial
  B2M gRNA target site sequence
tagccccaagtgaaataccc

SEQ ID NO: 1441 - DNA, 20 bp, Artificial
  B2M gRNA target site sequence
tgtcttttcccgatattcct

SEQ ID NO: 1442 - DNA, 20 bp, Artificial
  B2M gRNA target site sequence
gtcttttcccgatattcctc

SEQ ID NO: 1443 - DNA, 20 bp, Artificial
  B2M gRNA target site sequence
gatattcctcaggtactcca

SEQ ID NO: 1444 - DNA, 20 bp, Artificial
  B2M gRNA target site sequence
cctcaggtactccaaagatt

SEQ ID NO: 1445 - DNA, 20 bp, Artificial
  B2M gRNA target site sequence
ctcaggtactccaaagattc

SEQ ID NO: 1446 - DNA, 20 bp, Artificial
  B2M gRNA target site sequence
tcaggtttactcacgtcatc

SEQ ID NO: 1447 - DNA, 20 bp, Artificial
  B2M gRNA target site sequence
ggtttactcacgtcatccag

SEQ ID NO: 1448 - DNA, 20 bp, Artificial
  B2M gRNA target site sequence
tttactcacgtcatccagca

SEQ ID NO: 1449 - DNA, 20 bp, Artificial
  B2M gRNA target site sequence
tcacgtcatccagcagagaa

SEQ ID NO: 1450 - DNA, 20 bp, Artificial
  B2M gRNA target site sequence
gtcatccagcagagaatgga

SEQ ID NO: 1451 - DNA, 20 bp, Artificial
  B2M gRNA target site sequence
ttcctgaattgctatgtgtc

SEQ ID NO: 1452 - DNA, 20 bp, Artificial
  B2M gRNA target site sequence
tcctgaattgctatgtgtct

SEQ ID NO: 1453 - DNA, 20 bp, Artificial
  B2M gRNA target site sequence
gtttcatccatccgacattg

SEQ ID NO: 1454 - DNA, 20 bp, Artificial
  B2M gRNA target site sequence
acattgaagttgacttactg

SEQ ID NO: 1455 - DNA, 20 bp, Artificial
  B2M gRNA target site sequence
gaagttgacttactgaagaa

SEQ ID NO: 1456 - DNA, 20 bp, Artificial
  B2M gRNA target site sequence
agttgacttactgaagaatg

SEQ ID NO: 1457 - DNA, 20 bp, Artificial
  B2M gRNA target site sequence
ttgacttactgaagaatgga

SEQ ID NO: 1458 - DNA, 20 bp, Artificial
  B2M gRNA target site sequence
gacttactgaagaatggaga

SEQ ID NO: 1459 - DNA, 20 bp, Artificial
  B2M gRNA target site sequence
gaatggagagagaattgaaa

SEQ ID NO: 1460 - DNA, 20 bp, Artificial
  B2M gRNA target site sequence
tggagagagaattgaaaaag

SEQ ID NO: 1461 - DNA, 20 bp, Artificial
  B2M gRNA target site sequence
gagagagaattgaaaaagtg

SEQ ID NO: 1462 - DNA, 20 bp, Artificial
  B2M gRNA target site sequence
aattgaaaaagtggagcatt

SEQ ID NO: 1463 - DNA, 20 bp, Artificial
  B2M gRNA target site sequence
gagcattcagacttgtcttt

SEQ ID NO: 1464 - DNA, 20 bp, Artificial
  B2M gRNA target site sequence
attcagacttgtctttcagc

SEQ ID NO: 1465 - DNA, 20 bp, Artificial
  B2M gRNA target site sequence
ttcagacttgtctttcagca

SEQ ID NO: 1466 - DNA, 20 bp, Artificial
  B2M gRNA target site sequence
acttgtctttcagcaaggac

SEQ ID NO: 1467 - DNA, 20 bp, Artificial
  B2M gRNA target site sequence
tgaattcacccccactgaaa

SEQ ID NO: 1468 - DNA, 20 bp, Artificial
  B2M gRNA target site sequence
tcacccccactgaaaaagat

SEQ ID NO: 1469 - DNA, 20 bp, Artificial
  B2M gRNA target site sequence
tgaaccatgtgactttgtca

SEQ ID NO: 1470 - DNA, 20 bp, Artificial
  B2M gRNA target site sequence
atgtgactttgtcacagccc

SEQ ID NO: 1471 - DNA, 20 bp, Artificial
  B2M gRNA target site sequence
gactttgtcacagcccaaga

SEQ ID NO: 1472 - DNA, 20 bp, Artificial
  B2M gRNA target site sequence
tgtcacagcccaagatagtt

SEQ ID NO: 1473 - DNA, 20 bp, Artificial
  B2M gRNA target site sequence
cacagcccaagatagttaag

SEQ ID NO: 1474 - DNA, 20 bp, Artificial
  B2M gRNA target site sequence
acagcccaagatagttaagt

SEQ ID NO: 1475 - DNA, 20 bp, Artificial
  B2M gRNA target site sequence
cagcccaagatagttaagtg

SEQ ID NO: 1476 - DNA, 20 bp, Artificial
  B2M gRNA target site sequence
ccaagatagttaagtggggt

SEQ ID NO: 1477 - DNA, 20 bp, Artificial
  B2M gRNA target site sequence
taagtcttacattcttttgt

SEQ ID NO: 1478 - DNA, 20 bp, Artificial
  B2M gRNA target site sequence
attcttttgtaagctgctga

SEQ ID NO: 1479 - DNA, 20 bp, Artificial
  B2M gRNA target site sequence
agctgctgaaagttgtgtat

SEQ ID NO: 1480 - DNA, 20 bp, Artificial
  B2M gRNA target site sequence
tgctgaaagttgtgtatgag

SEQ ID NO: 1481 - DNA, 20 bp, Artificial
  B2M gRNA target site sequence
gtatgagtagtcatatcata

SEQ ID NO: 1482 - DNA, 20 bp, Artificial
  B2M gRNA target site sequence
aaagctgctttgatataaaa

SEQ ID NO: 1483 - DNA, 20 bp, Artificial
  B2M gRNA target site sequence
aagctgctttgatataaaaa

SEQ ID NO: 1484 - DNA, 20 bp, Artificial
  B2M gRNA target site sequence
tttgatataaaaaaggtcta

SEQ ID NO: 1485 - DNA, 20 bp, Artificial
  B2M gRNA target site sequence
atggccatactaccctgaat

SEQ ID NO: 1486 - DNA, 20 bp, Artificial
  B2M gRNA target site sequence
gatataaacaatctgcatat

SEQ ID NO: 1487 - DNA, 20 bp, Artificial
  B2M gRNA target site sequence
atataaacaatctgcatatt

SEQ ID NO: 1488 - DNA, 20 bp, Artificial
  B2M gRNA target site sequence
aatctgcatattgggattgt

SEQ ID NO: 1489 - DNA, 20 bp, Artificial
  B2M gRNA target site sequence
atctgcatattgggattgtc

SEQ ID NO: 1490 - DNA, 20 bp, Artificial
  B2M gRNA target site sequence
tctgcatattgggattgtca

SEQ ID NO: 1491 - DNA, 20 bp, Artificial
  B2M gRNA target site sequence
attgtcagggaatgttctta

SEQ ID NO: 1492 - DNA, 20 bp, Artificial
  B2M gRNA target site sequence
cagggaatgttcttaaagat

SEQ ID NO: 1493 - DNA, 20 bp, Artificial
  B2M gRNA target site sequence
aatgttcttaaagatcagat

SEQ ID NO: 1494 - DNA, 20 bp, Artificial
  B2M gRNA target site sequence
gttcttaaagatcagattag

SEQ ID NO: 1495 - DNA, 20 bp, Artificial
  B2M gRNA target site sequence
tcagattagtggcacctgct

SEQ ID NO: 1496 - DNA, 20 bp, Artificial
  B2M gRNA target site sequence
cctgctgagatactgatgca

SEQ ID NO: 1497 - DNA, 20 bp, Artificial
  B2M gRNA target site sequence
tgagatactgatgcacagca

SEQ ID NO: 1498 - DNA, 20 bp, Artificial
  B2M gRNA target site sequence
gcacagcatggtttctgaac

SEQ ID NO: 1499 - DNA, 20 bp, Artificial
  B2M gRNA target site sequence
cagcatggtttctgaaccag

SEQ ID NO: 1500 - DNA, 20 bp, Artificial
  B2M gRNA target site sequence
ctgaaccagtagtttccctg

SEQ ID NO: 1501 - DNA, 20 bp, Artificial
  B2M gRNA target site sequence
ccagtagtttccctgcagtt

SEQ ID NO: 1502 - DNA, 20 bp, Artificial
  B2M gRNA target site sequence
gtagtttccctgcagttgag

SEQ ID NO: 1503 - DNA, 20 bp, Artificial
  B2M gRNA target site sequence
tagtttccctgcagttgagc

SEQ ID NO: 1504 - DNA, 20 bp, Artificial
  B2M gRNA target site sequence
agtttccctgcagttgagca

SEQ ID NO: 1505 - DNA, 20 bp, Artificial
  B2M gRNA target site sequence
tttccctgcagttgagcagg

SEQ ID NO: 1506 - DNA, 20 bp, Artificial
  B2M gRNA target site sequence
ccctgcagttgagcagggag

SEQ ID NO: 1507 - DNA, 20 bp, Artificial
  B2M gRNA target site sequence
tgcagttgagcagggagcag

SEQ ID NO: 1508 - DNA, 20 bp, Artificial
  B2M gRNA target site sequence
agttgagcagggagcagcag

SEQ ID NO: 1509 - DNA, 20 bp, Artificial
  B2M gRNA target site sequence
tcttaacacttcttacctac

SEQ ID NO: 1510 - DNA, 20 bp, Artificial
  B2M gRNA target site sequence
tcttacctactggcttcctc

SEQ ID NO: 1511 - DNA, 20 bp, Artificial
  B2M gRNA target site sequence
ctggcttcctctagcttttg

SEQ ID NO: 1512 - DNA, 20 bp, Artificial
  B2M gRNA target site sequence
gcttcctctagcttttgtgg

SEQ ID NO: 1513 - DNA, 20 bp, Artificial
  B2M gRNA target site sequence
tctagcttttgtggcagctt

SEQ ID NO: 1514 - DNA, 20 bp, Artificial
  B2M gRNA target site sequence
ctagcttttgtggcagcttc

SEQ ID NO: 1515 - DNA, 20 bp, Artificial
  B2M gRNA target site sequence
gtggcagcttcaggtatatt

SEQ ID NO: 1516 - DNA, 20 bp, Artificial
  B2M gRNA target site sequence
tagcactgaacgaacatctc

SEQ ID NO: 1517 - DNA, 20 bp, Artificial
  B2M gRNA target site sequence
cactgaacgaacatctcaag

SEQ ID NO: 1518 - DNA, 20 bp, Artificial
  B2M gRNA target site sequence
actgaacgaacatctcaaga

SEQ ID NO: 1519 - DNA, 20 bp, Artificial
  B2M gRNA target site sequence
acgaacatctcaagaaggta

SEQ ID NO: 1520 - DNA, 20 bp, Artificial
  B2M gRNA target site sequence
cgaacatctcaagaaggtat

SEQ ID NO: 1521 - DNA, 20 bp, Artificial
  B2M gRNA target site sequence
aggtataggcctttgtttgt

SEQ ID NO: 1522 - DNA, 20 bp, Artificial
  B2M gRNA target site sequence
gtttgtaagtcctgctgtcc

SEQ ID NO: 1523 - DNA, 20 bp, Artificial
  B2M gRNA target site sequence
gtcctagcatcctataatcc

SEQ ID NO: 1524 - DNA, 20 bp, Artificial
  B2M gRNA target site sequence
cctataatcctggacttctc

SEQ ID NO: 1525 - DNA, 20 bp, Artificial
  B2M gRNA target site sequence
tggacttctccagtactttc

SEQ ID NO: 1526 - DNA, 20 bp, Artificial
  B2M gRNA target site sequence
cttctccagtactttctggc

SEQ ID NO: 1527 - DNA, 20 bp, Artificial
  B2M gRNA target site sequence
ccagtactttctggctggat

SEQ ID NO: 1528 - DNA, 20 bp, Artificial
  B2M gRNA target site sequence
ttctggctggattggtatct

SEQ ID NO: 1529 - DNA, 20 bp, Artificial
  B2M gRNA target site sequence
tctggctggattggtatctg

SEQ ID NO: 1530 - DNA, 20 bp, Artificial
  B2M gRNA target site sequence
gctggattggtatctgaggc

SEQ ID NO: 1531 - DNA, 20 bp, Artificial
  B2M gRNA target site sequence
ggattggtatctgaggctag

SEQ ID NO: 1532 - DNA, 20 bp, Artificial
  B2M gRNA target site sequence
gattggtatctgaggctagt

SEQ ID NO: 1533 - DNA, 20 bp, Artificial
  B2M gRNA target site sequence
tggtatctgaggctagtagg

SEQ ID NO: 1534 - DNA, 20 bp, Artificial
  B2M gRNA target site sequence
ggtatctgaggctagtagga

SEQ ID NO: 1535 - DNA, 20 bp, Artificial
  B2M gRNA target site sequence
gtatctgaggctagtaggaa

SEQ ID NO: 1536 - DNA, 20 bp, Artificial
  B2M gRNA target site sequence
taggaagggcttgttcctgc

SEQ ID NO: 1537 - DNA, 20 bp, Artificial
  B2M gRNA target site sequence
aggaagggcttgttcctgct

SEQ ID NO: 1538 - DNA, 20 bp, Artificial
  B2M gRNA target site sequence
aagggcttgttcctgctggg

SEQ ID NO: 1539 - DNA, 20 bp, Artificial
  B2M gRNA target site sequence
agctctaaacaatgtattca

SEQ ID NO: 1540 - DNA, 20 bp, Artificial
  B2M gRNA target site sequence
gctctaaacaatgtattcat

SEQ ID NO: 1541 - DNA, 20 bp, Artificial
  B2M gRNA target site sequence
ctaaacaatgtattcatggg

SEQ ID NO: 1542 - DNA, 20 bp, Artificial
  B2M gRNA target site sequence
taaacaatgtattcatgggt

SEQ ID NO: 1543 - DNA, 20 bp, Artificial
  B2M gRNA target site sequence
aatgtattcatgggtaggaa

SEQ ID NO: 1544 - DNA, 20 bp, Artificial
  B2M gRNA target site sequence
gtattcatgggtaggaacag

SEQ ID NO: 1545 - DNA, 20 bp, Artificial
  B2M gRNA target site sequence
ggaacagcagcctattctgc

SEQ ID NO: 1546 - DNA, 20 bp, Artificial
  B2M gRNA target site sequence
agccttatttctaaccattt

SEQ ID NO: 1547 - DNA, 20 bp, Artificial
  B2M gRNA target site sequence
taaccattttagacatttgt

SEQ ID NO: 1548 - DNA, 20 bp, Artificial
  B2M gRNA target site sequence
tttagacatttgttagtaca

SEQ ID NO: 1549 - DNA, 20 bp, Artificial
  B2M gRNA target site sequence
gttagtacatggtattttaa

SEQ ID NO: 1550 - DNA, 20 bp, Artificial
  B2M gRNA target site sequence
tttctccactgtctttttca

SEQ ID NO: 1551 - DNA, 20 bp, Artificial
  B2M gRNA target site sequence
cactgtctttttcatagatc

SEQ ID NO: 1552 - DNA, 20 bp, Artificial
  B2M gRNA target site sequence
tttcatagatcgagacatgt

SEQ ID NO: 1553 - DNA, 20 bp, Artificial
  B2M gRNA target site sequence
catagatcgagacatgtaag

SEQ ID NO: 1554 - DNA, 20 bp, Artificial
  B2M gRNA target site sequence
gagacatgtaagcagcatca

SEQ ID NO: 1555 - DNA, 20 bp, Artificial
  B2M gRNA target site sequence
gacatgtaagcagcatcatg

SEQ ID NO: 1556 - DNA, 20 bp, Artificial
  B2M gRNA target site sequence
acatgtaagcagcatcatgg

SEQ ID NO: 1557 - DNA, 20 bp, Artificial
  B2M gRNA target site sequence
gtaagcagcatcatggaggt

SEQ ID NO: 1558 - DNA, 20 bp, Artificial
  B2M gRNA target site sequence
ggaggtaagtttttgacctt

SEQ ID NO: 1559 - DNA, 20 bp, Artificial
  B2M gRNA target site sequence
tgtttttgtttcactgtcct

SEQ ID NO: 1560 - DNA, 20 bp, Artificial
  B2M gRNA target site sequence
gtttttgtttcactgtcctg

SEQ ID NO: 1561 - DNA, 20 bp, Artificial
  B2M gRNA target site sequence
actgtcctgaggactattta

SEQ ID NO: 1562 - DNA, 20 bp, Artificial
  B2M gRNA target site sequence
tcctgaggactatttataga

SEQ ID NO: 1563 - DNA, 20 bp, Artificial
  B2M gRNA target site sequence
acatgataaccctcactatg

SEQ ID NO: 1564 - DNA, 20 bp, Artificial
  B2M gRNA target site sequence
atgataaccctcactatgtg

SEQ ID NO: 1565 - DNA, 20 bp, Artificial
  B2M gRNA target site sequence
cactatgtggagaacattga

SEQ ID NO: 1566 - DNA, 20 bp, Artificial
  B2M gRNA target site sequence
ctatgtggagaacattgaca

SEQ ID NO: 1567 - DNA, 20 bp, Artificial
  B2M gRNA target site sequence
acattgacagagtaacattt

SEQ ID NO: 1568 - DNA, 20 bp, Artificial
  B2M gRNA target site sequence
ttgacagagtaacattttag

SEQ ID NO: 1569 - DNA, 20 bp, Artificial
  B2M gRNA target site sequence
tgacagagtaacattttagc

SEQ ID NO: 1570 - DNA, 20 bp, Artificial
  B2M gRNA target site sequence
gacagagtaacattttagca

SEQ ID NO: 1571 - DNA, 20 bp, Artificial
  B2M gRNA target site sequence
gagtaacattttagcaggga

SEQ ID NO: 1572 - DNA, 20 bp, Artificial
  B2M gRNA target site sequence
taacattttagcagggaaag

SEQ ID NO: 1573 - DNA, 20 bp, Artificial
  B2M gRNA target site sequence
gcagggaaagaagaatccta

SEQ ID NO: 1574 - DNA, 20 bp, Artificial
  B2M gRNA target site sequence
cagggaaagaagaatcctac

SEQ ID NO: 1575 - DNA, 20 bp, Artificial
  B2M gRNA target site sequence
agggaaagaagaatcctaca

SEQ ID NO: 1576 - DNA, 20 bp, Artificial
  B2M gRNA target site sequence
ggtcatgttcccttctcctg

SEQ ID NO: 1577 - DNA, 20 bp, Artificial
  B2M gRNA target site sequence
tcatgttcccttctcctgtg

SEQ ID NO: 1578 - DNA, 20 bp, Artificial
  B2M gRNA target site sequence
tgttcccttctcctgtggag

SEQ ID NO: 1579 - DNA, 20 bp, Artificial
  B2M gRNA target site sequence
ttctcctgtggagtggcatg

SEQ ID NO: 1580 - DNA, 20 bp, Artificial
  B2M gRNA target site sequence
tcctgtggagtggcatgaag

SEQ ID NO: 1581 - DNA, 20 bp, Artificial
  B2M gRNA target site sequence
cctgtggagtggcatgaaga

SEQ ID NO: 1582 - DNA, 20 bp, Artificial
  B2M gRNA target site sequence
agtggcatgaagaaggtgta

SEQ ID NO: 1583 - DNA, 20 bp, Artificial
  B2M gRNA target site sequence
atgaagaaggtgtatggccc

SEQ ID NO: 1584 - DNA, 20 bp, Artificial
  B2M gRNA target site sequence
tgaagaaggtgtatggcccc

SEQ ID NO: 1585 - DNA, 20 bp, Artificial
  B2M gRNA target site sequence
aaggtgtatggccccaggta

SEQ ID NO: 1586 - DNA, 20 bp, Artificial
  B2M gRNA target site sequence
gccatattactgaccctcta

SEQ ID NO: 1587 - DNA, 20 bp, Artificial
  B2M gRNA target site sequence
catattactgaccctctaca

SEQ ID NO: 1588 - DNA, 20 bp, Artificial
  B2M gRNA target site sequence
tattactgaccctctacaga

SEQ ID NO: 1589 - DNA, 20 bp, Artificial
  B2M gRNA target site sequence
attactgaccctctacagag

SEQ ID NO: 1590 - DNA, 20 bp, Artificial
  B2M gRNA target site sequence
ttactgaccctctacagaga

SEQ ID NO: 1591 - DNA, 20 bp, Artificial
  B2M gRNA target site sequence
gaccctctacagagagggca

SEQ ID NO: 1592 - DNA, 20 bp, Artificial
  B2M gRNA target site sequence
accctctacagagagggcaa

SEQ ID NO: 1593 - DNA, 20 bp, Artificial
  B2M gRNA target site sequence
agagagggcaaaggaactgc

SEQ ID NO: 1594 - DNA, 20 bp, Artificial
  B2M gRNA target site sequence
gggcaaaggaactgccagta

SEQ ID NO: 1595 - DNA, 20 bp, Artificial
  B2M gRNA target site sequence
gaactgccagtatggtattg

SEQ ID NO: 1596 - DNA, 20 bp, Artificial
  B2M gRNA target site sequence
aactgccagtatggtattgc

SEQ ID NO: 1597 - DNA, 20 bp, Artificial
  B2M gRNA target site sequence
cagtatggtattgcaggata

SEQ ID NO: 1598 - DNA, 20 bp, Artificial
  B2M gRNA target site sequence
agtatggtattgcaggataa

SEQ ID NO: 1599 - DNA, 20 bp, Artificial
  B2M gRNA target site sequence
atggtattgcaggataaagg

SEQ ID NO: 1600 - DNA, 20 bp, Artificial
  B2M gRNA target site sequence
tggtattgcaggataaaggc

SEQ ID NO: 1601 - DNA, 20 bp, Artificial
  B2M gRNA target site sequence
tattgcaggataaaggcagg

SEQ ID NO: 1602 - DNA, 20 bp, Artificial
  B2M gRNA target site sequence
tggttacccacattacctgc

SEQ ID NO: 1603 - DNA, 20 bp, Artificial
  B2M gRNA target site sequence
ggttacccacattacctgca

SEQ ID NO: 1604 - DNA, 20 bp, Artificial
  B2M gRNA target site sequence
ttcttctgccatttccacat

SEQ ID NO: 1605 - DNA, 20 bp, Artificial
  B2M gRNA target site sequence
ccacattggacatctctgct

SEQ ID NO: 1606 - DNA, 20 bp, Artificial
  B2M gRNA target site sequence
cacattggacatctctgctg

SEQ ID NO: 1607 - DNA, 20 bp, Artificial
  B2M gRNA target site sequence
cattggacatctctgctgag

SEQ ID NO: 1608 - DNA, 20 bp, Artificial
  B2M gRNA target site sequence
ttggacatctctgctgagga

SEQ ID NO: 1609 - DNA, 20 bp, Artificial
  B2M gRNA target site sequence
tataatgttgttttattctt

SEQ ID NO: 1610 - DNA, 20 bp, Artificial
  B2M gRNA target site sequence
atgttgttttattcttcaga

SEQ ID NO: 1611 - DNA, 20 bp, Artificial
  B2M gRNA target site sequence
ttgttttattcttcagacag

SEQ ID NO: 1612 - DNA, 20 bp, Artificial
  B2M gRNA target site sequence
gttttattcttcagacagaa

SEQ ID NO: 1613 - DNA, 20 bp, Artificial
  B2M gRNA target site sequence
tttattcttcagacagaaga

SEQ ID NO: 1614 - DNA, 20 bp, Artificial
  B2M gRNA target site sequence
ttattcttcagacagaagag

SEQ ID NO: 1615 - DNA, 20 bp, Artificial
  B2M gRNA target site sequence
attcttcagacagaagagag

SEQ ID NO: 1616 - DNA, 20 bp, Artificial
  B2M gRNA target site sequence
gacagaagagaggagttata

SEQ ID NO: 1617 - DNA, 20 bp, Artificial
  B2M gRNA target site sequence
agaggagttatacagctctg

SEQ ID NO: 1618 - DNA, 20 bp, Artificial
  B2M gRNA target site sequence
gcagacatcccattcctgta

SEQ ID NO: 1619 - DNA, 20 bp, Artificial
  B2M gRNA target site sequence
cagacatcccattcctgtat

SEQ ID NO: 1620 - DNA, 20 bp, Artificial
  B2M gRNA target site sequence
agacatcccattcctgtatg

SEQ ID NO: 1621 - DNA, 20 bp, Artificial
  B2M gRNA target site sequence
tggggactgtgtttgcctct

SEQ ID NO: 1622 - DNA, 20 bp, Artificial
  B2M gRNA target site sequence
gggactgtgtttgcctctta

SEQ ID NO: 1623 - DNA, 20 bp, Artificial
  B2M gRNA target site sequence
ggactgtgtttgcctcttag

SEQ ID NO: 1624 - DNA, 20 bp, Artificial
  B2M gRNA target site sequence
gtttgcctcttagaggttcc

SEQ ID NO: 1625 - DNA, 20 bp, Artificial
  B2M gRNA target site sequence
tttgcctcttagaggttccc

SEQ ID NO: 1626 - DNA, 20 bp, Artificial
  B2M gRNA target site sequence
cttagaggttcccaggccac

SEQ ID NO: 1627 - DNA, 20 bp, Artificial
  B2M gRNA target site sequence
tagaggttcccaggccacta

SEQ ID NO: 1628 - DNA, 20 bp, Artificial
  B2M gRNA target site sequence
agaggttcccaggccactag

SEQ ID NO: 1629 - DNA, 20 bp, Artificial
  B2M gRNA target site sequence
aggttcccaggccactagag

SEQ ID NO: 1630 - DNA, 20 bp, Artificial
  B2M gRNA target site sequence
ccaggccactagaggagata

SEQ ID NO: 1631 - DNA, 20 bp, Artificial
  B2M gRNA target site sequence
caggccactagaggagataa

SEQ ID NO: 1632 - DNA, 20 bp, Artificial
  B2M gRNA target site sequence
aggccactagaggagataaa

SEQ ID NO: 1633 - DNA, 20 bp, Artificial
  B2M gRNA target site sequence
ctagaggagataaagggaaa

SEQ ID NO: 1634 - DNA, 20 bp, Artificial
  B2M gRNA target site sequence
ttgatataatgatactataa

SEQ ID NO: 1635 - DNA, 20 bp, Artificial
  B2M gRNA target site sequence
actataatagatgtaactac

SEQ ID NO: 1636 - DNA, 20 bp, Artificial
  B2M gRNA target site sequence
ctataatagatgtaactaca

SEQ ID NO: 1637 - DNA, 20 bp, Artificial
  B2M gRNA target site sequence
ataatagatgtaactacaag

SEQ ID NO: 1638 - DNA, 20 bp, Artificial
  B2M gRNA target site sequence
gatgtaactacaaggagctc

SEQ ID NO: 1639 - DNA, 20 bp, Artificial
  B2M gRNA target site sequence
gtaactacaaggagctccag

SEQ ID NO: 1640 - DNA, 20 bp, Artificial
  B2M gRNA target site sequence
ctacaaggagctccagaagc

SEQ ID NO: 1641 - DNA, 20 bp, Artificial
  B2M gRNA target site sequence
acaaggagctccagaagcaa

SEQ ID NO: 1642 - DNA, 20 bp, Artificial
  B2M gRNA target site sequence
aaggagctccagaagcaaga

SEQ ID NO: 1643 - DNA, 20 bp, Artificial
  B2M gRNA target site sequence
ggagctccagaagcaagaga

SEQ ID NO: 1644 - DNA, 20 bp, Artificial
  B2M gRNA target site sequence
gagctccagaagcaagagag

SEQ ID NO: 1645 - DNA, 20 bp, Artificial
  B2M gRNA target site sequence
agctccagaagcaagagaga

SEQ ID NO: 1646 - DNA, 20 bp, Artificial
  B2M gRNA target site sequence
ctccagaagcaagagagagg

SEQ ID NO: 1647 - DNA, 20 bp, Artificial
  B2M gRNA target site sequence
tccagaagcaagagagaggg

SEQ ID NO: 1648 - DNA, 20 bp, Artificial
  B2M gRNA target site sequence
gcaagagagagggaggaact

SEQ ID NO: 1649 - DNA, 20 bp, Artificial
  B2M gRNA target site sequence
cttggacttctctgcatctt

SEQ ID NO: 1650 - DNA, 20 bp, Artificial
  B2M gRNA target site sequence
gacttctctgcatctttagt

SEQ ID NO: 1651 - DNA, 20 bp, Artificial
  B2M gRNA target site sequence
cttctctgcatctttagttg

SEQ ID NO: 1652 - DNA, 20 bp, Artificial
  B2M gRNA target site sequence
gcatctttagttggagtcca

SEQ ID NO: 1653 - DNA, 20 bp, Artificial
  B2M gRNA target site sequence
catctttagttggagtccaa

SEQ ID NO: 1654 - DNA, 20 bp, Artificial
  B2M gRNA target site sequence
ttcaatgaaattctactgcc

SEQ ID NO: 1655 - DNA, 20 bp, Artificial
  B2M gRNA target site sequence
tcaatgaaattctactgccc

SEQ ID NO: 1656 - DNA, 20 bp, Artificial
  B2M gRNA target site sequence
caatgaaattctactgccca

SEQ ID NO: 1657 - DNA, 20 bp, Artificial
  B2M gRNA target site sequence
tcaaatctcctgttatattc

SEQ ID NO: 1658 - DNA, 20 bp, Artificial
  B2M gRNA target site sequence
tctcctgttatattctagaa

SEQ ID NO: 1659 - DNA, 20 bp, Artificial
  B2M gRNA target site sequence
ctcctgttatattctagaac

SEQ ID NO: 1660 - DNA, 20 bp, Artificial
  B2M gRNA target site sequence
tcctgttatattctagaaca

SEQ ID NO: 1661 - DNA, 20 bp, Artificial
  B2M gRNA target site sequence
tctagaacagggaattgatt

SEQ ID NO: 1662 - DNA, 20 bp, Artificial
  B2M gRNA target site sequence
ctagaacagggaattgattt

SEQ ID NO: 1663 - DNA, 20 bp, Artificial
  B2M gRNA target site sequence
agaacagggaattgatttgg

SEQ ID NO: 1664 - DNA, 20 bp, Artificial
  B2M gRNA target site sequence
aacagggaattgatttggga

SEQ ID NO: 1665 - DNA, 20 bp, Artificial
  B2M gRNA target site sequence
gaattgatttgggagagcat

SEQ ID NO: 1666 - DNA, 20 bp, Artificial
  B2M gRNA target site sequence
aattgatttgggagagcatc

SEQ ID NO: 1667 - DNA, 20 bp, Artificial
  B2M gRNA target site sequence
tgatttgggagagcatcagg

SEQ ID NO: 1668 - DNA, 20 bp, Artificial
  B2M gRNA target site sequence
gatttgggagagcatcagga

SEQ ID NO: 1669 - DNA, 20 bp, Artificial
  B2M gRNA target site sequence
ttgggagagcatcaggaagg

SEQ ID NO: 1670 - DNA, 20 bp, Artificial
  B2M gRNA target site sequence
aggaaggtggatgatctgcc

SEQ ID NO: 1671 - DNA, 20 bp, Artificial
  B2M gRNA target site sequence
gatctgcccagtcacactgt

SEQ ID NO: 1672 - DNA, 20 bp, Artificial
  B2M gRNA target site sequence
gtcacactgttagtaaattg

SEQ ID NO: 1673 - DNA, 20 bp, Artificial
  B2M gRNA target site sequence
cacactgttagtaaattgta

SEQ ID NO: 1674 - DNA, 20 bp, Artificial
  B2M gRNA target site sequence
ctgttagtaaattgtagagc

SEQ ID NO: 1675 - DNA, 20 bp, Artificial
  B2M gRNA target site sequence
tgttagtaaattgtagagcc

SEQ ID NO: 1676 - DNA, 20 bp, Artificial
  B2M gRNA target site sequence
ccaggacctgaactctaata

SEQ ID NO: 1677 - DNA, 20 bp, Artificial
  B2M gRNA target site sequence
agtcatgtgttacttaatga

SEQ ID NO: 1678 - DNA, 20 bp, Artificial
  B2M gRNA target site sequence
gtcatgtgttacttaatgac

SEQ ID NO: 1679 - DNA, 20 bp, Artificial
  B2M gRNA target site sequence
tcatgtgttacttaatgacg

SEQ ID NO: 1680 - DNA, 20 bp, Artificial
  B2M gRNA target site sequence
taatgacggggacatgttct

SEQ ID NO: 1681 - DNA, 20 bp, Artificial
  B2M gRNA target site sequence
gagaaatgcttacacaaacc

SEQ ID NO: 1682 - DNA, 20 bp, Artificial
  B2M gRNA target site sequence
agaaatgcttacacaaacct

SEQ ID NO: 1683 - DNA, 20 bp, Artificial
  B2M gRNA target site sequence
ttacacaaacctaggtgttg

SEQ ID NO: 1684 - DNA, 20 bp, Artificial
  B2M gRNA target site sequence
gttgtagcctactacacgca

SEQ ID NO: 1685 - DNA, 20 bp, Artificial
  B2M gRNA target site sequence
ttgtagcctactacacgcat

SEQ ID NO: 1686 - DNA, 20 bp, Artificial
  B2M gRNA target site sequence
tactacacgcataggctaca

SEQ ID NO: 1687 - DNA, 20 bp, Artificial
  B2M gRNA target site sequence
cacgcataggctacatggta

SEQ ID NO: 1688 - DNA, 20 bp, Artificial
  B2M gRNA target site sequence
atggtatagcctattgctcc

SEQ ID NO: 1689 - DNA, 20 bp, Artificial
  B2M gRNA target site sequence
tcctagactacaaacctgta

SEQ ID NO: 1690 - DNA, 20 bp, Artificial
  B2M gRNA target site sequence
tgttactgtactgaatactg

SEQ ID NO: 1691 - DNA, 20 bp, Artificial
  B2M gRNA target site sequence
gttactgtactgaatactgt

SEQ ID NO: 1692 - DNA, 20 bp, Artificial
  B2M gRNA target site sequence
actgtactgaatactgtggg

SEQ ID NO: 1693 - DNA, 20 bp, Artificial
  B2M gRNA target site sequence
tgtgggcagttgtaacacaa

SEQ ID NO: 1694 - DNA, 20 bp, Artificial
  B2M gRNA target site sequence
ggcagttgtaacacaatggt

SEQ ID NO: 1695 - DNA, 20 bp, Artificial
  B2M gRNA target site sequence
agtatttgtgtatctaaaca

SEQ ID NO: 1696 - DNA, 20 bp, Artificial
  B2M gRNA target site sequence
atttgtgtatctaaacatag

SEQ ID NO: 1697 - DNA, 20 bp, Artificial
  B2M gRNA target site sequence
gtatctaaacatagaagttg

SEQ ID NO: 1698 - DNA, 20 bp, Artificial
  B2M gRNA target site sequence
atatgctattttaatcttat

SEQ ID NO: 1699 - DNA, 20 bp, Artificial
  B2M gRNA target site sequence
tgagaccactgtcatatata

SEQ ID NO: 1700 - DNA, 20 bp, Artificial
  B2M gRNA target site sequence
cattgaccaaaacatcatat

SEQ ID NO: 1701 - DNA, 20 bp, Artificial
  B2M gRNA target site sequence
atatcagcattttttcttct

SEQ ID NO: 1702 - DNA, 20 bp, Artificial
  B2M gRNA target site sequence
cattttttcttctaagattt

SEQ ID NO: 1703 - DNA, 20 bp, Artificial
  B2M gRNA target site sequence
attttttcttctaagatttt

SEQ ID NO: 1704 - DNA, 20 bp, Artificial
  B2M gRNA target site sequence
tttttcttctaagattttgg

SEQ ID NO: 1705 - DNA, 20 bp, Artificial
  B2M gRNA target site sequence
ctaagattttgggagcacca

SEQ ID NO: 1706 - DNA, 20 bp, Artificial
  B2M gRNA target site sequence
taagattttgggagcaccaa

SEQ ID NO: 1707 - DNA, 20 bp, Artificial
  B2M gRNA target site sequence
aagattttgggagcaccaaa

SEQ ID NO: 1708 - DNA, 20 bp, Artificial
  B2M gRNA target site sequence
gcaccaaagggatacactaa

SEQ ID NO: 1709 - DNA, 20 bp, Artificial
  B2M gRNA target site sequence
caccaaagggatacactaac

SEQ ID NO: 1710 - DNA, 20 bp, Artificial
  B2M gRNA target site sequence
acaggatatactctttataa

SEQ ID NO: 1711 - DNA, 20 bp, Artificial
  B2M gRNA target site sequence
caggatatactctttataat

SEQ ID NO: 1712 - DNA, 20 bp, Artificial
  B2M gRNA target site sequence
tatactctttataatgggtt

SEQ ID NO: 1713 - DNA, 20 bp, Artificial
  B2M gRNA target site sequence
tactctttataatgggtttg

SEQ ID NO: 1714 - DNA, 20 bp, Artificial
  B2M gRNA target site sequence
tgggtttggagaactgtctg

SEQ ID NO: 1715 - DNA, 20 bp, Artificial
  B2M gRNA target site sequence
ctgcagctacttcttttaaa

SEQ ID NO: 1716 - DNA, 20 bp, Artificial
  B2M gRNA target site sequence
tgcagctacttcttttaaaa

SEQ ID NO: 1717 - DNA, 20 bp, Artificial
  B2M gRNA target site sequence
ttttaaaaaggtgatctaca

SEQ ID NO: 1718 - DNA, 20 bp, Artificial
  B2M gRNA target site sequence
taaaaaggtgatctacacag

SEQ ID NO: 1719 - DNA, 20 bp, Artificial
  B2M gRNA target site sequence
gtgatctacacagtagaaat

SEQ ID NO: 1720 - DNA, 20 bp, Artificial
  B2M gRNA target site sequence
ctacacagtagaaattagac

SEQ ID NO: 1721 - DNA, 20 bp, Artificial
  B2M gRNA target site sequence
cagtagaaattagacaagtt

SEQ ID NO: 1722 - DNA, 20 bp, Artificial
  B2M gRNA target site sequence
aattagacaagtttggtaat

SEQ ID NO: 1723 - DNA, 20 bp, Artificial
  B2M gRNA target site sequence
taacctttttcttttctttt

SEQ ID NO: 1724 - DNA, 20 bp, Artificial
  B2M gRNA target site sequence
aacctttttcttttcttttc

SEQ ID NO: 1725 - DNA, 20 bp, Artificial
  B2M gRNA target site sequence
ttcttttcttttcaggtttg

SEQ ID NO: 1726 - DNA, 20 bp, Artificial
  B2M gRNA target site sequence
aggtttgaagatgccgcatt

SEQ ID NO: 1727 - DNA, 20 bp, Artificial
  B2M gRNA target site sequence
tgaagatgccgcatttggat

SEQ ID NO: 1728 - DNA, 20 bp, Artificial
  B2M gRNA target site sequence
tacactttatgcacaaaatg

SEQ ID NO: 1729 - DNA, 20 bp, Artificial
  B2M gRNA target site sequence
acactttatgcacaaaatgt

SEQ ID NO: 1730 - DNA, 20 bp, Artificial
  B2M gRNA target site sequence
cactttatgcacaaaatgta

SEQ ID NO: 1731 - DNA, 20 bp, Artificial
  B2M gRNA target site sequence
gggttataataatgttaaca

SEQ ID NO: 1732 - DNA, 20 bp, Artificial
  B2M gRNA target site sequence
cttctttataattctacttt

SEQ ID NO: 1733 - DNA, 20 bp, Artificial
  B2M gRNA target site sequence
tctccatgtttgatgtatct

SEQ ID NO: 1734 - DNA, 20 bp, Artificial
  B2M gRNA target site sequence
ccatgtttgatgtatctgag

SEQ ID NO: 1735 - DNA, 20 bp, Artificial
  B2M gRNA target site sequence
catgtttgatgtatctgagc

SEQ ID NO: 1736 - DNA, 20 bp, Artificial
  B2M gRNA target site sequence
tatctgagcaggttgctcca

SEQ ID NO: 1737 - DNA, 20 bp, Artificial
  B2M gRNA target site sequence
atctgagcaggttgctccac

SEQ ID NO: 1738 - DNA, 20 bp, Artificial
  B2M gRNA target site sequence
tgagcaggttgctccacagg

SEQ ID NO: 1739 - DNA, 20 bp, Artificial
  B2M gRNA target site sequence
ggttgctccacaggtagctc

SEQ ID NO: 1740 - DNA, 20 bp, Artificial
  B2M gRNA target site sequence
gttgctccacaggtagctct

SEQ ID NO: 1741 - DNA, 20 bp, Artificial
  B2M gRNA target site sequence
tgctccacaggtagctctag

SEQ ID NO: 1742 - DNA, 20 bp, Artificial
  B2M gRNA target site sequence
gctccacaggtagctctagg

SEQ ID NO: 1743 - DNA, 20 bp, Artificial
  B2M gRNA target site sequence
ctccacaggtagctctagga

SEQ ID NO: 1744 - DNA, 20 bp, Artificial
  B2M gRNA target site sequence
acaggtagctctaggagggc

SEQ ID NO: 1745 - DNA, 20 bp, Artificial
  B2M gRNA target site sequence
ctctaggagggctggcaact

SEQ ID NO: 1746 - DNA, 20 bp, Artificial
  B2M gRNA target site sequence
ctaggagggctggcaactta

SEQ ID NO: 1747 - DNA, 20 bp, Artificial
  B2M gRNA target site sequence
taggagggctggcaacttag

SEQ ID NO: 1748 - DNA, 20 bp, Artificial
  B2M gRNA target site sequence
gagggctggcaacttagagg

SEQ ID NO: 1749 - DNA, 20 bp, Artificial
  B2M gRNA target site sequence
agggctggcaacttagaggt

SEQ ID NO: 1750 - DNA, 20 bp, Artificial
  B2M gRNA target site sequence
gggctggcaacttagaggtg

SEQ ID NO: 1751 - DNA, 20 bp, Artificial
  B2M gRNA target site sequence
gctggcaacttagaggtggg

SEQ ID NO: 1752 - DNA, 20 bp, Artificial
  B2M gRNA target site sequence
ggcaacttagaggtggggag

SEQ ID NO: 1753 - DNA, 20 bp, Artificial
  B2M gRNA target site sequence
caacttagaggtggggagca

SEQ ID NO: 1754 - DNA, 20 bp, Artificial
  B2M gRNA target site sequence
cttatccaacatcaacatct

SEQ ID NO: 1755 - DNA, 20 bp, Artificial
  B2M gRNA target site sequence
tccaacatcaacatcttggt

SEQ ID NO: 1756 - DNA, 20 bp, Artificial
  B2M gRNA target site sequence
tcttcaatctcttgcactca

SEQ ID NO: 1757 - DNA, 20 bp, Artificial
  B2M gRNA target site sequence
tcttgcactcaaagcttgtt

SEQ ID NO: 1758 - DNA, 20 bp, Artificial
  B2M gRNA target site sequence
gcactcaaagcttgttaaga

SEQ ID NO: 1759 - DNA, 20 bp, Artificial
  B2M gRNA target site sequence
caaagcttgttaagatagtt

SEQ ID NO: 1760 - DNA, 20 bp, Artificial
  B2M gRNA target site sequence
taagatagttaagcgtgcat

SEQ ID NO: 1761 - DNA, 20 bp, Artificial
  B2M gRNA target site sequence
tccaatttacatactctgct

SEQ ID NO: 1762 - DNA, 20 bp, Artificial
  B2M gRNA target site sequence
tacatactctgcttagaatt

SEQ ID NO: 1763 - DNA, 20 bp, Artificial
  B2M gRNA target site sequence
acatactctgcttagaattt

SEQ ID NO: 1764 - DNA, 20 bp, Artificial
  B2M gRNA target site sequence
catactctgcttagaatttg

SEQ ID NO: 1765 - DNA, 20 bp, Artificial
  B2M gRNA target site sequence
atactctgcttagaatttgg

SEQ ID NO: 1766 - DNA, 20 bp, Artificial
  B2M gRNA target site sequence
ttagaatttgggggaaaatt

SEQ ID NO: 1767 - DNA, 20 bp, Artificial
  B2M gRNA target site sequence
aaatttagaaatataattga

SEQ ID NO: 1768 - DNA, 20 bp, Artificial
  B2M gRNA target site sequence
aatttagaaatataattgac

SEQ ID NO: 1769 - DNA, 20 bp, Artificial
  B2M gRNA target site sequence
aatataattgacaggattat

SEQ ID NO: 1770 - DNA, 20 bp, Artificial
  B2M gRNA target site sequence
aatgaaacattttgtcatat

SEQ ID NO: 1771 - DNA, 20 bp, Artificial
  B2M gRNA target site sequence
tacttcttatacatttgata

SEQ ID NO: 1772 - DNA, 20 bp, Artificial
  B2M gRNA target site sequence
tcttatacatttgataaagt

SEQ ID NO: 1773 - DNA, 20 bp, Artificial
  B2M gRNA target site sequence
cttatacatttgataaagta

SEQ ID NO: 1774 - DNA, 20 bp, Artificial
  B2M gRNA target site sequence
acatttgataaagtaaggca

SEQ ID NO: 1775 - DNA, 20 bp, Artificial
  B2M gRNA target site sequence
gataaagtaaggcatggttg

SEQ ID NO: 1776 - DNA, 20 bp, Artificial
  B2M gRNA target site sequence
aggcatggttgtggttaatc

SEQ ID NO: 1777 - DNA, 20 bp, Artificial
  B2M gRNA target site sequence
ctggtttatttttgttccac

SEQ ID NO: 1778 - DNA, 20 bp, Artificial
  B2M gRNA target site sequence
attacccctttattttcaaa

SEQ ID NO: 1779 - DNA, 20 bp, Artificial
  B2M gRNA target site sequence
ttacccctttattttcaaac

SEQ ID NO: 1780 - DNA, 20 bp, Artificial
  B2M gRNA target site sequence
tacccctttattttcaaaca

SEQ ID NO: 1781 - DNA, 20 bp, Artificial
  B2M gRNA target site sequence
tttattttcaaacagggaaa

SEQ ID NO: 1782 - DNA, 20 bp, Artificial
  B2M gRNA target site sequence
tgtttccctgtttgaaaata

SEQ ID NO: 1783 - DNA, 20 bp, Artificial
  B2M gRNA target site sequence
gtttccctgtttgaaaataa

SEQ ID NO: 1784 - DNA, 20 bp, Artificial
  B2M gRNA target site sequence
tttccctgtttgaaaataaa

SEQ ID NO: 1785 - DNA, 20 bp, Artificial
  B2M gRNA target site sequence
ttccctgtttgaaaataaag

SEQ ID NO: 1786 - DNA, 20 bp, Artificial
  B2M gRNA target site sequence
gtttgaaaataaaggggtaa

SEQ ID NO: 1787 - DNA, 20 bp, Artificial
  B2M gRNA target site sequence
tgaaaataaaggggtaatag

SEQ ID NO: 1788 - DNA, 20 bp, Artificial
  B2M gRNA target site sequence
gaaaataaaggggtaatagt

SEQ ID NO: 1789 - DNA, 20 bp, Artificial
  B2M gRNA target site sequence
aaataaaggggtaatagtgg

SEQ ID NO: 1790 - DNA, 20 bp, Artificial
  B2M gRNA target site sequence
aaaggggtaatagtgggagt

SEQ ID NO: 1791 - DNA, 20 bp, Artificial
  B2M gRNA target site sequence
taatagtgggagtgagatat

SEQ ID NO: 1792 - DNA, 20 bp, Artificial
  B2M gRNA target site sequence
atagtgggagtgagatataa

SEQ ID NO: 1793 - DNA, 20 bp, Artificial
  B2M gRNA target site sequence
gatataagagataacacatc

SEQ ID NO: 1794 - DNA, 20 bp, Artificial
  B2M gRNA target site sequence
tttatgatttatttaacttg

SEQ ID NO: 1795 - DNA, 20 bp, Artificial
  B2M gRNA target site sequence
cttgtggaacaaaaataaac

SEQ ID NO: 1796 - DNA, 20 bp, Artificial
  B2M gRNA target site sequence
ccttactttatcaaatgtat

SEQ ID NO: 1797 - DNA, 20 bp, Artificial
  B2M gRNA target site sequence
tactttatcaaatgtataag

SEQ ID NO: 1798 - DNA, 20 bp, Artificial
  B2M gRNA target site sequence
taaattttcccccaaattct

SEQ ID NO: 1799 - DNA, 20 bp, Artificial
  B2M gRNA target site sequence
attttcccccaaattctaag

SEQ ID NO: 1800 - DNA, 20 bp, Artificial
  B2M gRNA target site sequence
tttcccccaaattctaagca

SEQ ID NO: 1801 - DNA, 20 bp, Artificial
  B2M gRNA target site sequence
tctaagcagagtatgtaaat

SEQ ID NO: 1802 - DNA, 20 bp, Artificial
  B2M gRNA target site sequence
aagcagagtatgtaaattgg

SEQ ID NO: 1803 - DNA, 20 bp, Artificial
  B2M gRNA target site sequence
gcacgcttaactatcttaac

SEQ ID NO: 1804 - DNA, 20 bp, Artificial
  B2M gRNA target site sequence
taactatcttaacaagcttt

SEQ ID NO: 1805 - DNA, 20 bp, Artificial
  B2M gRNA target site sequence
tcttaacaagctttgagtgc

SEQ ID NO: 1806 - DNA, 20 bp, Artificial
  B2M gRNA target site sequence
ttaacaagctttgagtgcaa

SEQ ID NO: 1807 - DNA, 20 bp, Artificial
  B2M gRNA target site sequence
gctttgagtgcaagagattg

SEQ ID NO: 1808 - DNA, 20 bp, Artificial
  B2M gRNA target site sequence
tttgagtgcaagagattgaa

SEQ ID NO: 1809 - DNA, 20 bp, Artificial
  B2M gRNA target site sequence
tgaagagttcaaatctgacc

SEQ ID NO: 1810 - DNA, 20 bp, Artificial
  B2M gRNA target site sequence
tctgaccaagatgttgatgt

SEQ ID NO: 1811 - DNA, 20 bp, Artificial
  B2M gRNA target site sequence
ccaagatgttgatgttggat

SEQ ID NO: 1812 - DNA, 20 bp, Artificial
  B2M gRNA target site sequence
aagatgttgatgttggataa

SEQ ID NO: 1813 - DNA, 20 bp, Artificial
  B2M gRNA target site sequence
attctctgctccccacctct

SEQ ID NO: 1814 - DNA, 20 bp, Artificial
  B2M gRNA target site sequence
gctccccacctctaagttgc

SEQ ID NO: 1815 - DNA, 20 bp, Artificial
  B2M gRNA target site sequence
ctctaagttgccagccctcc

SEQ ID NO: 1816 - DNA, 20 bp, Artificial
  B2M gRNA target site sequence
ctaagttgccagccctccta

SEQ ID NO: 1817 - DNA, 20 bp, Artificial
  B2M gRNA target site sequence
agccctcctagagctacctg

SEQ ID NO: 1818 - DNA, 20 bp, Artificial
  B2M gRNA target site sequence
ccctcctagagctacctgtg

SEQ ID NO: 1819 - DNA, 20 bp, Artificial
  B2M gRNA target site sequence
tacctgtggagcaacctgct

SEQ ID NO: 1820 - DNA, 20 bp, Artificial
  B2M gRNA target site sequence
ctgctcagatacatcaaaca

SEQ ID NO: 1821 - DNA, 20 bp, Artificial
  B2M gRNA target site sequence
gctcagatacatcaaacatg

SEQ ID NO: 1822 - DNA, 20 bp, Artificial
  B2M gRNA target site sequence
agatacatcaaacatggaga

SEQ ID NO: 1823 - DNA, 20 bp, Artificial
  B2M gRNA target site sequence
aaacatggagacagcactca

SEQ ID NO: 1824 - DNA, 20 bp, Artificial
  B2M gRNA target site sequence
catggagacagcactcaaag

SEQ ID NO: 1825 - DNA, 20 bp, Artificial
  B2M gRNA target site sequence
gcactcaaagtagaattata

SEQ ID NO: 1826 - DNA, 20 bp, Artificial
  B2M gRNA target site sequence
ctcaaagtagaattataaag

SEQ ID NO: 1827 - DNA, 20 bp, Artificial
  B2M gRNA target site sequence
aaccctacattttgtgcata

SEQ ID NO: 1828 - DNA, 20 bp, Artificial
  B2M gRNA target site sequence
acattttgtgcataaagtgt

SEQ ID NO: 1829 - DNA, 20 bp, Artificial
  B2M gRNA target site sequence
tgcataaagtgtaagtgtat

SEQ ID NO: 1830 - DNA, 20 bp, Artificial
  B2M gRNA target site sequence
ataagcatatcaatattaaa

SEQ ID NO: 1831 - DNA, 20 bp, Artificial
  B2M gRNA target site sequence
gcatatcaatattaaaaagc

SEQ ID NO: 1832 - DNA, 20 bp, Artificial
  B2M gRNA target site sequence
atcaatattaaaaagcaagc

SEQ ID NO: 1833 - DNA, 20 bp, Artificial
  B2M gRNA target site sequence
aatattaaaaagcaagcaag

SEQ ID NO: 1834 - DNA, 20 bp, Artificial
  B2M gRNA target site sequence
aaaagcaagcaagcagaatt

SEQ ID NO: 1835 - DNA, 20 bp, Artificial
  B2M gRNA target site sequence
gaattcatccaatccaaatg

SEQ ID NO: 1836 - DNA, 20 bp, Artificial
  B2M gRNA target site sequence
gcggcatcttcaaacctgaa

SEQ ID NO: 1837 - DNA, 20 bp, Artificial
  B2M gRNA target site sequence
atcttcaaacctgaaaagaa

SEQ ID NO: 1838 - DNA, 20 bp, Artificial
  B2M gRNA target site sequence
aaacctgaaaagaaaagaaa

SEQ ID NO: 1839 - DNA, 20 bp, Artificial
  B2M gRNA target site sequence
aacctgaaaagaaaagaaaa

SEQ ID NO: 1840 - DNA, 20 bp, Artificial
  B2M gRNA target site sequence
tgaaaagaaaagaaaaaggt

SEQ ID NO: 1841 - DNA, 20 bp, Artificial
  B2M gRNA target site sequence
agcaatgaatttattttatt

SEQ ID NO: 1842 - DNA, 20 bp, Artificial
  B2M gRNA target site sequence
aatttattttatttggattg

SEQ ID NO: 1843 - DNA, 20 bp, Artificial
  B2M gRNA target site sequence
cttgtctaatttctactgtg

SEQ ID NO: 1844 - DNA, 20 bp, Artificial
  B2M gRNA target site sequence
tgtgtagatcacctttttaa

SEQ ID NO: 1845 - DNA, 20 bp, Artificial
  B2M gRNA target site sequence
gtagatcacctttttaaaag

SEQ ID NO: 1846 - DNA, 20 bp, Artificial
  B2M gRNA target site sequence
gatcacctttttaaaagaag

SEQ ID NO: 1847 - DNA, 20 bp, Artificial
  B2M gRNA target site sequence
ctttttaaaagaagtagctg

SEQ ID NO: 1848 - DNA, 20 bp, Artificial
  B2M gRNA target site sequence
ttaaaagaagtagctgcaga

SEQ ID NO: 1849 - DNA, 20 bp, Artificial
  B2M gRNA target site sequence
agttctccaaacccattata

SEQ ID NO: 1850 - DNA, 20 bp, Artificial
  B2M gRNA target site sequence
ttctccaaacccattataaa

SEQ ID NO: 1851 - DNA, 20 bp, Artificial
  B2M gRNA target site sequence
ttataaagagtatatcctgt

SEQ ID NO: 1852 - DNA, 20 bp, Artificial
  B2M gRNA target site sequence
atcctgttagtgtatccctt

SEQ ID NO: 1853 - DNA, 20 bp, Artificial
  B2M gRNA target site sequence
ctttggtgctcccaaaatct

SEQ ID NO: 1854 - DNA, 20 bp, Artificial
  B2M gRNA target site sequence
tggtgctcccaaaatcttag

SEQ ID NO: 1855 - DNA, 20 bp, Artificial
  B2M gRNA target site sequence
aaaatgctgatatgatgttt

SEQ ID NO: 1856 - DNA, 20 bp, Artificial
  B2M gRNA target site sequence
tatgatgttttggtcaatga

SEQ ID NO: 1857 - DNA, 20 bp, Artificial
  B2M gRNA target site sequence
atgatggactgtatatatga

SEQ ID NO: 1858 - DNA, 20 bp, Artificial
  B2M gRNA target site sequence
atggactgtatatatgacag

SEQ ID NO: 1859 - DNA, 20 bp, Artificial
  B2M gRNA target site sequence
atatatgacagtggtctcat

SEQ ID NO: 1860 - DNA, 20 bp, Artificial
  B2M gRNA target site sequence
gtggtctcataagattaaaa

SEQ ID NO: 1861 - DNA, 20 bp, Artificial
  B2M gRNA target site sequence
tttactgcaacttctatgtt

SEQ ID NO: 1862 - DNA, 20 bp, Artificial
  B2M gRNA target site sequence
cattgtgttacaactgccca

SEQ ID NO: 1863 - DNA, 20 bp, Artificial
  B2M gRNA target site sequence
ttacaactgcccacagtatt

SEQ ID NO: 1864 - DNA, 20 bp, Artificial
  B2M gRNA target site sequence
actgcccacagtattcagta

SEQ ID NO: 1865 - DNA, 20 bp, Artificial
  B2M gRNA target site sequence
cacagtattcagtacagtaa

SEQ ID NO: 1866 - DNA, 20 bp, Artificial
  B2M gRNA target site sequence
acagtattcagtacagtaac

SEQ ID NO: 1867 - DNA, 20 bp, Artificial
  B2M gRNA target site sequence
cagtacagtaacaggctgta

SEQ ID NO: 1868 - DNA, 20 bp, Artificial
  B2M gRNA target site sequence
agtacagtaacaggctgtac

SEQ ID NO: 1869 - DNA, 20 bp, Artificial
  B2M gRNA target site sequence
taacaggctgtacaggtttg

SEQ ID NO: 1870 - DNA, 20 bp, Artificial
  B2M gRNA target site sequence
ggctgtacaggtttgtagtc

SEQ ID NO: 1871 - DNA, 20 bp, Artificial
  B2M gRNA target site sequence
gctgtacaggtttgtagtct

SEQ ID NO: 1872 - DNA, 20 bp, Artificial
  B2M gRNA target site sequence
tgtacaggtttgtagtctag

SEQ ID NO: 1873 - DNA, 20 bp, Artificial
  B2M gRNA target site sequence
ggtttgtagtctaggagcaa

SEQ ID NO: 1874 - DNA, 20 bp, Artificial
  B2M gRNA target site sequence
gtttgtagtctaggagcaat

SEQ ID NO: 1875 - DNA, 20 bp, Artificial
  B2M gRNA target site sequence
gagcaataggctataccatg

SEQ ID NO: 1876 - DNA, 20 bp, Artificial
  B2M gRNA target site sequence
taccatgtagcctatgcgtg

SEQ ID NO: 1877 - DNA, 20 bp, Artificial
  B2M gRNA target site sequence
catgtagcctatgcgtgtag

SEQ ID NO: 1878 - DNA, 20 bp, Artificial
  B2M gRNA target site sequence
atgtagcctatgcgtgtagt

SEQ ID NO: 1879 - DNA, 20 bp, Artificial
  B2M gRNA target site sequence
gtgtagtaggctacaacacc

SEQ ID NO: 1880 - DNA, 20 bp, Artificial
  B2M gRNA target site sequence
tgtagtaggctacaacacct

SEQ ID NO: 1881 - DNA, 20 bp, Artificial
  B2M gRNA target site sequence
tacaacacctaggtttgtgt

SEQ ID NO: 1882 - DNA, 20 bp, Artificial
  B2M gRNA target site sequence
aggtttgtgtaagcatttct

SEQ ID NO: 1883 - DNA, 20 bp, Artificial
  B2M gRNA target site sequence
cagaacatgtccccgtcatt

SEQ ID NO: 1884 - DNA, 20 bp, Artificial
  B2M gRNA target site sequence
taagtaacacatgactatat

SEQ ID NO: 1885 - DNA, 20 bp, Artificial
  B2M gRNA target site sequence
agtaacacatgactatatta

SEQ ID NO: 1886 - DNA, 20 bp, Artificial
  B2M gRNA target site sequence
cacatgactatattagagtt

SEQ ID NO: 1887 - DNA, 20 bp, Artificial
  B2M gRNA target site sequence
acatgactatattagagttc

SEQ ID NO: 1888 - DNA, 20 bp, Artificial
  B2M gRNA target site sequence
ctatattagagttcaggtcc

SEQ ID NO: 1889 - DNA, 20 bp, Artificial
  B2M gRNA target site sequence
ctggctctacaatttactaa

SEQ ID NO: 1890 - DNA, 20 bp, Artificial
  B2M gRNA target site sequence
caatttactaacagtgtgac

SEQ ID NO: 1891 - DNA, 20 bp, Artificial
  B2M gRNA target site sequence
aatttactaacagtgtgact

SEQ ID NO: 1892 - DNA, 20 bp, Artificial
  B2M gRNA target site sequence
ttactaacagtgtgactggg

SEQ ID NO: 1893 - DNA, 20 bp, Artificial
  B2M gRNA target site sequence
cccaaatcaattccctgttc

SEQ ID NO: 1894 - DNA, 20 bp, Artificial
  B2M gRNA target site sequence
ttccctgttctagaatataa

SEQ ID NO: 1895 - DNA, 20 bp, Artificial
  B2M gRNA target site sequence
tccctgttctagaatataac

SEQ ID NO: 1896 - DNA, 20 bp, Artificial
  B2M gRNA target site sequence
cctgttctagaatataacag

SEQ ID NO: 1897 - DNA, 20 bp, Artificial
  B2M gRNA target site sequence
aatataacaggagatttgaa

SEQ ID NO: 1898 - DNA, 20 bp, Artificial
  B2M gRNA target site sequence
atataacaggagatttgaat

SEQ ID NO: 1899 - DNA, 20 bp, Artificial
  B2M gRNA target site sequence
tataacaggagatttgaatg

SEQ ID NO: 1900 - DNA, 20 bp, Artificial
  B2M gRNA target site sequence
aggagatttgaatggggttt

SEQ ID NO: 1901 - DNA, 20 bp, Artificial
  B2M gRNA target site sequence
gtttcagcatcaatgtaccc

SEQ ID NO: 1902 - DNA, 20 bp, Artificial
  B2M gRNA target site sequence
tttcagcatcaatgtaccct

SEQ ID NO: 1903 - DNA, 20 bp, Artificial
  B2M gRNA target site sequence
cagcatcaatgtaccctggg

SEQ ID NO: 1904 - DNA, 20 bp, Artificial
  B2M gRNA target site sequence
catcaatgtaccctgggcag

SEQ ID NO: 1905 - DNA, 20 bp, Artificial
  B2M gRNA target site sequence
ggcagtagaatttcattgaa

SEQ ID NO: 1906 - DNA, 20 bp, Artificial
  B2M gRNA target site sequence
gaatttcattgaaaagcctt

SEQ ID NO: 1907 - DNA, 20 bp, Artificial
  B2M gRNA target site sequence
aagcctttggactccaacta

SEQ ID NO: 1908 - DNA, 20 bp, Artificial
  B2M gRNA target site sequence
ttggactccaactaaagatg

SEQ ID NO: 1909 - DNA, 20 bp, Artificial
  B2M gRNA target site sequence
ggactccaactaaagatgca

SEQ ID NO: 1910 - DNA, 20 bp, Artificial
  B2M gRNA target site sequence
ctccaactaaagatgcagag

SEQ ID NO: 1911 - DNA, 20 bp, Artificial
  B2M gRNA target site sequence
ctaaagatgcagagaagtcc

SEQ ID NO: 1912 - DNA, 20 bp, Artificial
  B2M gRNA target site sequence
tcctccctctctcttgcttc

SEQ ID NO: 1913 - DNA, 20 bp, Artificial
  B2M gRNA target site sequence
ctccctctctcttgcttctg

SEQ ID NO: 1914 - DNA, 20 bp, Artificial
  B2M gRNA target site sequence
cttgcttctggagctccttg

SEQ ID NO: 1915 - DNA, 20 bp, Artificial
  B2M gRNA target site sequence
ccttgtagttacatctatta

SEQ ID NO: 1916 - DNA, 20 bp, Artificial
  B2M gRNA target site sequence
tattatagtatcattatatc

SEQ ID NO: 1917 - DNA, 20 bp, Artificial
  B2M gRNA target site sequence
ctgtttccctttatctcctc

SEQ ID NO: 1918 - DNA, 20 bp, Artificial
  B2M gRNA target site sequence
tttccctttatctcctctag

SEQ ID NO: 1919 - DNA, 20 bp, Artificial
  B2M gRNA target site sequence
ctttatctcctctagtggcc

SEQ ID NO: 1920 - DNA, 20 bp, Artificial
  B2M gRNA target site sequence
tttatctcctctagtggcct

SEQ ID NO: 1921 - DNA, 20 bp, Artificial
  B2M gRNA target site sequence
ctagtggcctgggaacctct

SEQ ID NO: 1922 - DNA, 20 bp, Artificial
  B2M gRNA target site sequence
agtggcctgggaacctctaa

SEQ ID NO: 1923 - DNA, 20 bp, Artificial
  B2M gRNA target site sequence
gtggcctgggaacctctaag

SEQ ID NO: 1924 - DNA, 20 bp, Artificial
  B2M gRNA target site sequence
gaacctctaagaggcaaaca

SEQ ID NO: 1925 - DNA, 20 bp, Artificial
  B2M gRNA target site sequence
aggcaaacacagtccccata

SEQ ID NO: 1926 - DNA, 20 bp, Artificial
  B2M gRNA target site sequence
ggcaaacacagtccccatac

SEQ ID NO: 1927 - DNA, 20 bp, Artificial
  B2M gRNA target site sequence
acacagtccccatacaggaa

SEQ ID NO: 1928 - DNA, 20 bp, Artificial
  B2M gRNA target site sequence
cacagtccccatacaggaat

SEQ ID NO: 1929 - DNA, 20 bp, Artificial
  B2M gRNA target site sequence
atacaggaatgggatgtctg

SEQ ID NO: 1930 - DNA, 20 bp, Artificial
  B2M gRNA target site sequence
acaggaatgggatgtctgca

SEQ ID NO: 1931 - DNA, 20 bp, Artificial
  B2M gRNA target site sequence
taactcctctcttctgtctg

SEQ ID NO: 1932 - DNA, 20 bp, Artificial
  B2M gRNA target site sequence
gaataaaacaacattataca

SEQ ID NO: 1933 - DNA, 20 bp, Artificial
  B2M gRNA target site sequence
aataaaacaacattatacaa

SEQ ID NO: 1934 - DNA, 20 bp, Artificial
  B2M gRNA target site sequence
aacaacattatacaaaggaa

SEQ ID NO: 1935 - DNA, 20 bp, Artificial
  B2M gRNA target site sequence
caacattatacaaaggaaaa

SEQ ID NO: 1936 - DNA, 20 bp, Artificial
  B2M gRNA target site sequence
cattatacaaaggaaaagag

SEQ ID NO: 1937 - DNA, 20 bp, Artificial
  B2M gRNA target site sequence
agtggttcattttctctcct

SEQ ID NO: 1938 - DNA, 20 bp, Artificial
  B2M gRNA target site sequence
ggttcattttctctcctcag

SEQ ID NO: 1939 - DNA, 20 bp, Artificial
  B2M gRNA target site sequence
ttcattttctctcctcagca

SEQ ID NO: 1940 - DNA, 20 bp, Artificial
  B2M gRNA target site sequence
ctcagcagagatgtccaatg

SEQ ID NO: 1941 - DNA, 20 bp, Artificial
  B2M gRNA target site sequence
agagatgtccaatgtggaaa

SEQ ID NO: 1942 - DNA, 20 bp, Artificial
  B2M gRNA target site sequence
gatgtccaatgtggaaatgg

SEQ ID NO: 1943 - DNA, 20 bp, Artificial
  B2M gRNA target site sequence
gtccaatgtggaaatggcag

SEQ ID NO: 1944 - DNA, 20 bp, Artificial
  B2M gRNA target site sequence
aatgtggaaatggcagaaga

SEQ ID NO: 1945 - DNA, 20 bp, Artificial
  B2M gRNA target site sequence
aaatggcagaagaaagatca

SEQ ID NO: 1946 - DNA, 20 bp, Artificial
  B2M gRNA target site sequence
gaagaaagatcaaagccttg

SEQ ID NO: 1947 - DNA, 20 bp, Artificial
  B2M gRNA target site sequence
aagaaagatcaaagccttgc

SEQ ID NO: 1948 - DNA, 20 bp, Artificial
  B2M gRNA target site sequence
tcaaagccttgcaggtaatg

SEQ ID NO: 1949 - DNA, 20 bp, Artificial
  B2M gRNA target site sequence
caaagccttgcaggtaatgt

SEQ ID NO: 1950 - DNA, 20 bp, Artificial
  B2M gRNA target site sequence
tttatcctgcaataccatac

SEQ ID NO: 1951 - DNA, 20 bp, Artificial
  B2M gRNA target site sequence
atcctgcaataccatactgg

SEQ ID NO: 1952 - DNA, 20 bp, Artificial
  B2M gRNA target site sequence
cagttcctttgccctctctg

SEQ ID NO: 1953 - DNA, 20 bp, Artificial
  B2M gRNA target site sequence
gttcctttgccctctctgta

SEQ ID NO: 1954 - DNA, 20 bp, Artificial
  B2M gRNA target site sequence
ttcctttgccctctctgtag

SEQ ID NO: 1955 - DNA, 20 bp, Artificial
  B2M gRNA target site sequence
tcctttgccctctctgtaga

SEQ ID NO: 1956 - DNA, 20 bp, Artificial
  B2M gRNA target site sequence
ttgccctctctgtagagggt

SEQ ID NO: 1957 - DNA, 20 bp, Artificial
  B2M gRNA target site sequence
tctgtagagggtcagtaata

SEQ ID NO: 1958 - DNA, 20 bp, Artificial
  B2M gRNA target site sequence
gtcagtaatatggccatacc

SEQ ID NO: 1959 - DNA, 20 bp, Artificial
  B2M gRNA target site sequence
tcagtaatatggccatacct

SEQ ID NO: 1960 - DNA, 20 bp, Artificial
  B2M gRNA target site sequence
cagtaatatggccatacctg

SEQ ID NO: 1961 - DNA, 20 bp, Artificial
  B2M gRNA target site sequence
accttcttcatgccactcca

SEQ ID NO: 1962 - DNA, 20 bp, Artificial
  B2M gRNA target site sequence
ccttcttcatgccactccac

SEQ ID NO: 1963 - DNA, 20 bp, Artificial
  B2M gRNA target site sequence
ttcttcatgccactccacag

SEQ ID NO: 1964 - DNA, 20 bp, Artificial
  B2M gRNA target site sequence
ttcatgccactccacaggag

SEQ ID NO: 1965 - DNA, 20 bp, Artificial
  B2M gRNA target site sequence
tcatgccactccacaggaga

SEQ ID NO: 1966 - DNA, 20 bp, Artificial
  B2M gRNA target site sequence
catgccactccacaggagaa

SEQ ID NO: 1967 - DNA, 20 bp, Artificial
  B2M gRNA target site sequence
gagaagggaacatgaccctg

SEQ ID NO: 1968 - DNA, 20 bp, Artificial
  B2M gRNA target site sequence
agaagggaacatgaccctgt

SEQ ID NO: 1969 - DNA, 20 bp, Artificial
  B2M gRNA target site sequence
ctctgtcaatgttctccaca

SEQ ID NO: 1970 - DNA, 20 bp, Artificial
  B2M gRNA target site sequence
gtcaatgttctccacatagt

SEQ ID NO: 1971 - DNA, 20 bp, Artificial
  B2M gRNA target site sequence
tcaatgttctccacatagtg

SEQ ID NO: 1972 - DNA, 20 bp, Artificial
  B2M gRNA target site sequence
caatgttctccacatagtga

SEQ ID NO: 1973 - DNA, 20 bp, Artificial
  B2M gRNA target site sequence
catagtgagggttatcatgt

SEQ ID NO: 1974 - DNA, 20 bp, Artificial
  B2M gRNA target site sequence
tagtgagggttatcatgtta

SEQ ID NO: 1975 - DNA, 20 bp, Artificial
  B2M gRNA target site sequence
atgttagagctgtctataaa

SEQ ID NO: 1976 - DNA, 20 bp, Artificial
  B2M gRNA target site sequence
agctgtctataaatagtcct

SEQ ID NO: 1977 - DNA, 20 bp, Artificial
  B2M gRNA target site sequence
gctgtctataaatagtcctc

SEQ ID NO: 1978 - DNA, 20 bp, Artificial
  B2M gRNA target site sequence
tctataaatagtcctcagga

SEQ ID NO: 1979 - DNA, 20 bp, Artificial
  B2M gRNA target site sequence
tgaaacaaaaacattttctc

SEQ ID NO: 1980 - DNA, 20 bp, Artificial
  B2M gRNA target site sequence
gaaacaaaaacattttctca

SEQ ID NO: 1981 - DNA, 20 bp, Artificial
  B2M gRNA target site sequence
acatgtctcgatctatgaaa

SEQ ID NO: 1982 - DNA, 20 bp, Artificial
  B2M gRNA target site sequence
gtctcgatctatgaaaaaga

SEQ ID NO: 1983 - DNA, 20 bp, Artificial
  B2M gRNA target site sequence
tcgatctatgaaaaagacag

SEQ ID NO: 1984 - DNA, 20 bp, Artificial
  B2M gRNA target site sequence
gatctatgaaaaagacagtg

SEQ ID NO: 1985 - DNA, 20 bp, Artificial
  B2M gRNA target site sequence
aaaagacagtggagaaaaaa

SEQ ID NO: 1986 - DNA, 20 bp, Artificial
  B2M gRNA target site sequence
aaagacagtggagaaaaaaa

SEQ ID NO: 1987 - DNA, 20 bp, Artificial
  B2M gRNA target site sequence
gacagtggagaaaaaaaagg

SEQ ID NO: 1988 - DNA, 20 bp, Artificial
  B2M gRNA target site sequence
agaaaaaaaaggaagacatt

SEQ ID NO: 1989 - DNA, 20 bp, Artificial
  B2M gRNA target site sequence
gtactaacaaatgtctaaaa

SEQ ID NO: 1990 - DNA, 20 bp, Artificial
  B2M gRNA target site sequence
taacaaatgtctaaaatggt

SEQ ID NO: 1991 - DNA, 20 bp, Artificial
  B2M gRNA target site sequence
tgtctaaaatggttagaaat

SEQ ID NO: 1992 - DNA, 20 bp, Artificial
  B2M gRNA target site sequence
gtctaaaatggttagaaata

SEQ ID NO: 1993 - DNA, 20 bp, Artificial
  B2M gRNA target site sequence
aaaatggttagaaataaggc

SEQ ID NO: 1994 - DNA, 20 bp, Artificial
  B2M gRNA target site sequence
atggttagaaataaggctgg

SEQ ID NO: 1995 - DNA, 20 bp, Artificial
  B2M gRNA target site sequence
tagaaataaggctggcagaa

SEQ ID NO: 1996 - DNA, 20 bp, Artificial
  B2M gRNA target site sequence
agaaataaggctggcagaat

SEQ ID NO: 1997 - DNA, 20 bp, Artificial
  B2M gRNA target site sequence
ctacccatgaatacattgtt

SEQ ID NO: 1998 - DNA, 20 bp, Artificial
  B2M gRNA target site sequence
acccatgaatacattgttta

SEQ ID NO: 1999 - DNA, 20 bp, Artificial
  B2M gRNA target site sequence
atacattgtttagagctacc

SEQ ID NO: 2000 - DNA, 20 bp, Artificial
  B2M gRNA target site sequence
cattgtttagagctacccag

SEQ ID NO: 2001 - DNA, 20 bp, Artificial
  B2M gRNA target site sequence
attgtttagagctacccagc

SEQ ID NO: 2002 - DNA, 20 bp, Artificial
  B2M gRNA target site sequence
tagagctacccagcaggaac

SEQ ID NO: 2003 - DNA, 20 bp, Artificial
  B2M gRNA target site sequence
caggaacaagcccttcctac

SEQ ID NO: 2004 - DNA, 20 bp, Artificial
  B2M gRNA target site sequence
caagcccttcctactagcct

SEQ ID NO: 2005 - DNA, 20 bp, Artificial
  B2M gRNA target site sequence
actagcctcagataccaatc

SEQ ID NO: 2006 - DNA, 20 bp, Artificial
  B2M gRNA target site sequence
gcctcagataccaatccagc

SEQ ID NO: 2007 - DNA, 20 bp, Artificial
  B2M gRNA target site sequence
cagataccaatccagccaga

SEQ ID NO: 2008 - DNA, 20 bp, Artificial
  B2M gRNA target site sequence
ccaatccagccagaaagtac

SEQ ID NO: 2009 - DNA, 20 bp, Artificial
  B2M gRNA target site sequence
aatccagccagaaagtactg

SEQ ID NO: 2010 - DNA, 20 bp, Artificial
  B2M gRNA target site sequence
ccagccagaaagtactggag

SEQ ID NO: 2011 - DNA, 20 bp, Artificial
  B2M gRNA target site sequence
cagaaagtactggagaagtc

SEQ ID NO: 2012 - DNA, 20 bp, Artificial
  B2M gRNA target site sequence
agaaagtactggagaagtcc

SEQ ID NO: 2013 - DNA, 20 bp, Artificial
  B2M gRNA target site sequence
actggagaagtccaggatta

SEQ ID NO: 2014 - DNA, 20 bp, Artificial
  B2M gRNA target site sequence
ctggagaagtccaggattat

SEQ ID NO: 2015 - DNA, 20 bp, Artificial
  B2M gRNA target site sequence
agtccaggattataggatgc

SEQ ID NO: 2016 - DNA, 20 bp, Artificial
  B2M gRNA target site sequence
gtccaggattataggatgct

SEQ ID NO: 2017 - DNA, 20 bp, Artificial
  B2M gRNA target site sequence
aggattataggatgctagga

SEQ ID NO: 2018 - DNA, 20 bp, Artificial
  B2M gRNA target site sequence
attataggatgctaggacag

SEQ ID NO: 2019 - DNA, 20 bp, Artificial
  B2M gRNA target site sequence
ttataggatgctaggacagc

SEQ ID NO: 2020 - DNA, 20 bp, Artificial
  B2M gRNA target site sequence
gacagcaggacttacaaaca

SEQ ID NO: 2021 - DNA, 20 bp, Artificial
  B2M gRNA target site sequence
acagcaggacttacaaacaa

SEQ ID NO: 2022 - DNA, 20 bp, Artificial
  B2M gRNA target site sequence
acaaaggcctataccttctt

SEQ ID NO: 2023 - DNA, 20 bp, Artificial
  B2M gRNA target site sequence
accttcttgagatgttcgtt

SEQ ID NO: 2024 - DNA, 20 bp, Artificial
  B2M gRNA target site sequence
ttcagtgctaaatatacctg

SEQ ID NO: 2025 - DNA, 20 bp, Artificial
  B2M gRNA target site sequence
tatacctgaagctgccacaa

SEQ ID NO: 2026 - DNA, 20 bp, Artificial
  B2M gRNA target site sequence
cctgaagctgccacaaaagc

SEQ ID NO: 2027 - DNA, 20 bp, Artificial
  B2M gRNA target site sequence
tgaagctgccacaaaagcta

SEQ ID NO: 2028 - DNA, 20 bp, Artificial
  B2M gRNA target site sequence
gaagctgccacaaaagctag

SEQ ID NO: 2029 - DNA, 20 bp, Artificial
  B2M gRNA target site sequence
gctgccacaaaagctagagg

SEQ ID NO: 2030 - DNA, 20 bp, Artificial
  B2M gRNA target site sequence
ccacaaaagctagaggaagc

SEQ ID NO: 2031 - DNA, 20 bp, Artificial
  B2M gRNA target site sequence
caaaagctagaggaagccag

SEQ ID NO: 2032 - DNA, 20 bp, Artificial
  B2M gRNA target site sequence
aaaagctagaggaagccagt

SEQ ID NO: 2033 - DNA, 20 bp, Artificial
  B2M gRNA target site sequence
gctagaggaagccagtaggt

SEQ ID NO: 2034 - DNA, 20 bp, Artificial
  B2M gRNA target site sequence
agaggaagccagtaggtaag

SEQ ID NO: 2035 - DNA, 20 bp, Artificial
  B2M gRNA target site sequence
gccagtaggtaagaagtgtt

SEQ ID NO: 2036 - DNA, 20 bp, Artificial
  B2M gRNA target site sequence
cagtaggtaagaagtgttaa

SEQ ID NO: 2037 - DNA, 20 bp, Artificial
  B2M gRNA target site sequence
gagtgtatatgtatttgtgc

SEQ ID NO: 2038 - DNA, 20 bp, Artificial
  B2M gRNA target site sequence
tgctgctccctgctcaactg

SEQ ID NO: 2039 - DNA, 20 bp, Artificial
  B2M gRNA target site sequence
gctgctccctgctcaactgc

SEQ ID NO: 2040 - DNA, 20 bp, Artificial
  B2M gRNA target site sequence
ctgctccctgctcaactgca

SEQ ID NO: 2041 - DNA, 20 bp, Artificial
  B2M gRNA target site sequence
ctcaactgcagggaaactac

SEQ ID NO: 2042 - DNA, 20 bp, Artificial
  B2M gRNA target site sequence
ctgcagggaaactactggtt

SEQ ID NO: 2043 - DNA, 20 bp, Artificial
  B2M gRNA target site sequence
tcagaaaccatgctgtgcat

SEQ ID NO: 2044 - DNA, 20 bp, Artificial
  B2M gRNA target site sequence
catgctgtgcatcagtatct

SEQ ID NO: 2045 - DNA, 20 bp, Artificial
  B2M gRNA target site sequence
gctgtgcatcagtatctcag

SEQ ID NO: 2046 - DNA, 20 bp, Artificial
  B2M gRNA target site sequence
ctgtgcatcagtatctcagc

SEQ ID NO: 2047 - DNA, 20 bp, Artificial
  B2M gRNA target site sequence
gtgccactaatctgatcttt

SEQ ID NO: 2048 - DNA, 20 bp, Artificial
  B2M gRNA target site sequence
tccctgacaatcccaatatg

SEQ ID NO: 2049 - DNA, 20 bp, Artificial
  B2M gRNA target site sequence
aatatgcagattgtttatat

SEQ ID NO: 2050 - DNA, 20 bp, Artificial
  B2M gRNA target site sequence
tgcagattgtttatatcaga

SEQ ID NO: 2051 - DNA, 20 bp, Artificial
  B2M gRNA target site sequence
gcagattgtttatatcagat

SEQ ID NO: 2052 - DNA, 20 bp, Artificial
  B2M gRNA target site sequence
attgtttatatcagatggga

SEQ ID NO: 2053 - DNA, 20 bp, Artificial
  B2M gRNA target site sequence
ttgtttatatcagatgggat

SEQ ID NO: 2054 - DNA, 20 bp, Artificial
  B2M gRNA target site sequence
cagatgggatgggactcatt

SEQ ID NO: 2055 - DNA, 20 bp, Artificial
  B2M gRNA target site sequence
agatgggatgggactcattc

SEQ ID NO: 2056 - DNA, 20 bp, Artificial
  B2M gRNA target site sequence
gatgggatgggactcattca

SEQ ID NO: 2057 - DNA, 20 bp, Artificial
  B2M gRNA target site sequence
gggatgggactcattcaggg

SEQ ID NO: 2058 - DNA, 20 bp, Artificial
  B2M gRNA target site sequence
gggactcattcagggtagta

SEQ ID NO: 2059 - DNA, 20 bp, Artificial
  B2M gRNA target site sequence
cattcagggtagtatggcca

SEQ ID NO: 2060 - DNA, 20 bp, Artificial
  B2M gRNA target site sequence
catagaccttttttatatca

SEQ ID NO: 2061 - DNA, 20 bp, Artificial
  B2M gRNA target site sequence
agaccttttttatatcaaag

SEQ ID NO: 2062 - DNA, 20 bp, Artificial
  B2M gRNA target site sequence
gactactcatacacaacttt

SEQ ID NO: 2063 - DNA, 20 bp, Artificial
  B2M gRNA target site sequence
tactcatacacaactttcag

SEQ ID NO: 2064 - DNA, 20 bp, Artificial
  B2M gRNA target site sequence
caactttcagcagcttacaa

SEQ ID NO: 2065 - DNA, 20 bp, Artificial
  B2M gRNA target site sequence
agcagcttacaaaagaatgt

SEQ ID NO: 2066 - DNA, 20 bp, Artificial
  B2M gRNA target site sequence
cttaccccacttaactatct

SEQ ID NO: 2067 - DNA, 20 bp, Artificial
  B2M gRNA target site sequence
ttaccccacttaactatctt

SEQ ID NO: 2068 - DNA, 20 bp, Artificial
  B2M gRNA target site sequence
aactatcttgggctgtgaca

SEQ ID NO: 2069 - DNA, 20 bp, Artificial
  B2M gRNA target site sequence
tgggctgtgacaaagtcaca

SEQ ID NO: 2070 - DNA, 20 bp, Artificial
  B2M gRNA target site sequence
acaaagtcacatggttcaca

SEQ ID NO: 2071 - DNA, 20 bp, Artificial
  B2M gRNA target site sequence
aagtcacatggttcacacgg

SEQ ID NO: 2072 - DNA, 20 bp, Artificial
  B2M gRNA target site sequence
agtcacatggttcacacggc

SEQ ID NO: 2073 - DNA, 20 bp, Artificial
  B2M gRNA target site sequence
gcaggcatactcatcttttt

SEQ ID NO: 2074 - DNA, 20 bp, Artificial
  B2M gRNA target site sequence
ggcatactcatctttttcag

SEQ ID NO: 2075 - DNA, 20 bp, Artificial
  B2M gRNA target site sequence
gcatactcatctttttcagt

SEQ ID NO: 2076 - DNA, 20 bp, Artificial
  B2M gRNA target site sequence
catactcatctttttcagtg

SEQ ID NO: 2077 - DNA, 20 bp, Artificial
  B2M gRNA target site sequence
atactcatctttttcagtgg

SEQ ID NO: 2078 - DNA, 20 bp, Artificial
  B2M gRNA target site sequence
tttttcagtgggggtgaatt

SEQ ID NO: 2079 - DNA, 20 bp, Artificial
  B2M gRNA target site sequence
cagtgggggtgaattcagtg

SEQ ID NO: 2080 - DNA, 20 bp, Artificial
  B2M gRNA target site sequence
gggtgaattcagtgtagtac

SEQ ID NO: 2081 - DNA, 20 bp, Artificial
  B2M gRNA target site sequence
gtgaattcagtgtagtacaa

SEQ ID NO: 2082 - DNA, 20 bp, Artificial
  B2M gRNA target site sequence
attcagtgtagtacaagaga

SEQ ID NO: 2083 - DNA, 20 bp, Artificial
  B2M gRNA target site sequence
agtgtagtacaagagataga

SEQ ID NO: 2084 - DNA, 20 bp, Artificial
  B2M gRNA target site sequence
agtacaagagatagaaagac

SEQ ID NO: 2085 - DNA, 20 bp, Artificial
  B2M gRNA target site sequence
gaaagaccagtccttgctga

SEQ ID NO: 2086 - DNA, 20 bp, Artificial
  B2M gRNA target site sequence
accagtccttgctgaaagac

SEQ ID NO: 2087 - DNA, 20 bp, Artificial
  B2M gRNA target site sequence
tcaattctctctccattctt

SEQ ID NO: 2088 - DNA, 20 bp, Artificial
  B2M gRNA target site sequence
ttctctctccattcttcagt

SEQ ID NO: 2089 - DNA, 20 bp, Artificial
  B2M gRNA target site sequence
cagtaagtcaacttcaatgt

SEQ ID NO: 2090 - DNA, 20 bp, Artificial
  B2M gRNA target site sequence
aagtcaacttcaatgtcgga

SEQ ID NO: 2091 - DNA, 20 bp, Artificial
  B2M gRNA target site sequence
aatgtcggatggatgaaacc

SEQ ID NO: 2092 - DNA, 20 bp, Artificial
  B2M gRNA target site sequence
atggatgaaacccagacaca

SEQ ID NO: 2093 - DNA, 20 bp, Artificial
  B2M gRNA target site sequence
aacccagacacatagcaatt

SEQ ID NO: 2094 - DNA, 20 bp, Artificial
  B2M gRNA target site sequence
acccagacacatagcaattc

SEQ ID NO: 2095 - DNA, 20 bp, Artificial
  B2M gRNA target site sequence
tttgactttccattctctgc

SEQ ID NO: 2096 - DNA, 20 bp, Artificial
  B2M gRNA target site sequence
cattctctgctggatgacgt

SEQ ID NO: 2097 - DNA, 20 bp, Artificial
  B2M gRNA target site sequence
cgtgagtaaacctgaatctt

SEQ ID NO: 2098 - DNA, 20 bp, Artificial
  B2M gRNA target site sequence
tgagtaaacctgaatctttg

SEQ ID NO: 2099 - DNA, 20 bp, Artificial
  B2M gRNA target site sequence
cctgaatctttggagtacct

SEQ ID NO: 2100 - DNA, 20 bp, Artificial
  B2M gRNA target site sequence
ctgaatctttggagtacctg

SEQ ID NO: 2101 - DNA, 20 bp, Artificial
  B2M gRNA target site sequence
ttggagtacctgaggaatat

SEQ ID NO: 2102 - DNA, 20 bp, Artificial
  B2M gRNA target site sequence
tggagtacctgaggaatatc

SEQ ID NO: 2103 - DNA, 20 bp, Artificial
  B2M gRNA target site sequence
tacctgaggaatatcgggaa

SEQ ID NO: 2104 - DNA, 20 bp, Artificial
  B2M gRNA target site sequence
aaaagacacattaatattgc

SEQ ID NO: 2105 - DNA, 20 bp, Artificial
  B2M gRNA target site sequence
aaagacacattaatattgcc

SEQ ID NO: 2106 - DNA, 20 bp, Artificial
  B2M gRNA target site sequence
aagacacattaatattgcca

SEQ ID NO: 2107 - DNA, 20 bp, Artificial
  B2M gRNA target site sequence
tattgccagggtatttcact

SEQ ID NO: 2108 - DNA, 20 bp, Artificial
  B2M gRNA target site sequence
attgccagggtatttcactt

SEQ ID NO: 2109 - DNA, 20 bp, Artificial
  B2M gRNA target site sequence
ttgccagggtatttcacttg

SEQ ID NO: 2110 - DNA, 20 bp, Artificial
  B2M gRNA target site sequence
tatttcacttggggctaact

SEQ ID NO: 2111 - DNA, 20 bp, Artificial
  B2M gRNA target site sequence
cttggggctaacttggtgtc

SEQ ID NO: 2112 - DNA, 20 bp, Artificial
  B2M gRNA target site sequence
aacttggtgtcaagctatat

SEQ ID NO: 2113 - DNA, 20 bp, Artificial
  B2M gRNA target site sequence
acttggtgtcaagctatatc

SEQ ID NO: 2114 - DNA, 20 bp, Artificial
  B2M gRNA target site sequence
gtcaagctatatcaggcacc

SEQ ID NO: 2115 - DNA, 20 bp, Artificial
  B2M gRNA target site sequence
aggcaccaagtgtttacatt

SEQ ID NO: 2116 - DNA, 20 bp, Artificial
  B2M gRNA target site sequence
tcccaattccatttccactc

SEQ ID NO: 2117 - DNA, 20 bp, Artificial
  B2M gRNA target site sequence
catttccactctggccaaat

SEQ ID NO: 2118 - DNA, 20 bp, Artificial
  B2M gRNA target site sequence
tgagcttccaccttcccaac

SEQ ID NO: 2119 - DNA, 20 bp, Artificial
  B2M gRNA target site sequence
aacaagccacctccattttg

SEQ ID NO: 2120 - DNA, 20 bp, Artificial
  B2M gRNA target site sequence
ttgaagaataaaccgtgact

SEQ ID NO: 2121 - DNA, 20 bp, Artificial
  B2M gRNA target site sequence
tgccttttttgttttttttc

SEQ ID NO: 2122 - DNA, 20 bp, Artificial
  B2M gRNA target site sequence
cttttttgttttttttctag

SEQ ID NO: 2123 - DNA, 20 bp, Artificial
  B2M gRNA target site sequence
ttttttttctagcagatttc

SEQ ID NO: 2124 - DNA, 20 bp, Artificial
  B2M gRNA target site sequence
tttttctagcagatttctag

SEQ ID NO: 2125 - DNA, 20 bp, Artificial
  B2M gRNA target site sequence
ctagcagtatcttctgtcac

SEQ ID NO: 2126 - DNA, 20 bp, Artificial
  B2M gRNA target site sequence
agcagtatcttctgtcactg

SEQ ID NO: 2127 - DNA, 20 bp, Artificial
  B2M gRNA target site sequence
ggagattgcgctgcattttt

SEQ ID NO: 2128 - DNA, 20 bp, Artificial
  B2M gRNA target site sequence
agattgcgctgcatttttaa

SEQ ID NO: 2129 - DNA, 20 bp, Artificial
  B2M gRNA target site sequence
catttttaagagcctttctc

SEQ ID NO: 2130 - DNA, 20 bp, Artificial
  B2M gRNA target site sequence
tttttaagagcctttctctg

SEQ ID NO: 2131 - DNA, 20 bp, Artificial
  B2M gRNA target site sequence
ttttaagagcctttctctgg

SEQ ID NO: 2132 - DNA, 20 bp, Artificial
  B2M gRNA target site sequence
gcctttctctggaggctctc

SEQ ID NO: 2133 - DNA, 20 bp, Artificial
  B2M gRNA target site sequence
cctttctctggaggctctca

SEQ ID NO: 2134 - DNA, 20 bp, Artificial
  B2M gRNA target site sequence
aaggacttctgatgccctct

SEQ ID NO: 2135 - DNA, 20 bp, Artificial
  B2M gRNA target site sequence
tgatgccctctcagcactca

SEQ ID NO: 2136 - DNA, 20 bp, Artificial
  B2M gRNA target site sequence
cattccttaacacatcactc

SEQ ID NO: 2137 - DNA, 20 bp, Artificial
  B2M gRNA target site sequence
ttccttaacacatcactcaa

SEQ ID NO: 2138 - DNA, 20 bp, Artificial
  B2M gRNA target site sequence
actcaagagtctacatgatt

SEQ ID NO: 2139 - DNA, 20 bp, Artificial
  B2M gRNA target site sequence
agtctacatgatttggcccc

SEQ ID NO: 2140 - DNA, 20 bp, Artificial
  B2M gRNA target site sequence
tggccccaagatacttttca

SEQ ID NO: 2141 - DNA, 20 bp, Artificial
  B2M gRNA target site sequence
acttttcaaagttcatttct

SEQ ID NO: 2142 - DNA, 20 bp, Artificial
  B2M gRNA target site sequence
gttcatttctcagttcataa

SEQ ID NO: 2143 - DNA, 20 bp, Artificial
  B2M gRNA target site sequence
tatgtttatgcctttctttt

SEQ ID NO: 2144 - DNA, 20 bp, Artificial
  B2M gRNA target site sequence
ctgattttctaaactgtatg

SEQ ID NO: 2145 - DNA, 20 bp, Artificial
  B2M gRNA target site sequence
tctaaactgtatgaagtgtc

SEQ ID NO: 2146 - DNA, 20 bp, Artificial
  B2M gRNA target site sequence
aaactgtatgaagtgtctag

SEQ ID NO: 2147 - DNA, 20 bp, Artificial
  B2M gRNA target site sequence
actgtatgaagtgtctagta

SEQ ID NO: 2148 - DNA, 20 bp, Artificial
  B2M gRNA target site sequence
gaagtgtctagtagagtgcc

SEQ ID NO: 2149 - DNA, 20 bp, Artificial
  B2M gRNA target site sequence
aagtgtctagtagagtgcct

SEQ ID NO: 2150 - DNA, 20 bp, Artificial
  B2M gRNA target site sequence
ctagtagagtgcctgggaca

SEQ ID NO: 2151 - DNA, 20 bp, Artificial
  B2M gRNA target site sequence
catagcaattgctctatacg

SEQ ID NO: 2152 - DNA, 20 bp, Artificial
  B2M gRNA target site sequence
agcaattgctctatacgtgg

SEQ ID NO: 2153 - DNA, 20 bp, Artificial
  B2M gRNA target site sequence
cgtggcagatgttattatct

SEQ ID NO: 2154 - DNA, 20 bp, Artificial
  B2M gRNA target site sequence
gtggcagatgttattatctg

SEQ ID NO: 2155 - DNA, 20 bp, Artificial
  B2M gRNA target site sequence
tgttattatctgaggttcct

SEQ ID NO: 2156 - DNA, 20 bp, Artificial
  B2M gRNA target site sequence
tattatctgaggttcctaag

SEQ ID NO: 2157 - DNA, 20 bp, Artificial
  B2M gRNA target site sequence
gttcctaagtggatcaaccc

SEQ ID NO: 2158 - DNA, 20 bp, Artificial
  B2M gRNA target site sequence
ttcctaagtggatcaaccca

SEQ ID NO: 2159 - DNA, 20 bp, Artificial
  B2M gRNA target site sequence
ttttttatttttttattttt

SEQ ID NO: 2160 - DNA, 20 bp, Artificial
  B2M gRNA target site sequence
tttttatttttttatttttt

SEQ ID NO: 2161 - DNA, 20 bp, Artificial
  B2M gRNA target site sequence
tatttttttattttttggga

SEQ ID NO: 2162 - DNA, 20 bp, Artificial
  B2M gRNA target site sequence
tggaatctcattccattgcc

SEQ ID NO: 2163 - DNA, 20 bp, Artificial
  B2M gRNA target site sequence
ggaatctcattccattgccc

SEQ ID NO: 2164 - DNA, 20 bp, Artificial
  B2M gRNA target site sequence
tctcattccattgcccaggc

SEQ ID NO: 2165 - DNA, 20 bp, Artificial
  B2M gRNA target site sequence
tcattccattgcccaggctg

SEQ ID NO: 2166 - DNA, 20 bp, Artificial
  B2M gRNA target site sequence
ccattgcccaggctggagtg

SEQ ID NO: 2167 - DNA, 20 bp, Artificial
  B2M gRNA target site sequence
ccaggctggagtgcagtgtg

SEQ ID NO: 2168 - DNA, 20 bp, Artificial
  B2M gRNA target site sequence
ggctggagtgcagtgtgcag

SEQ ID NO: 2169 - DNA, 20 bp, Artificial
  B2M gRNA target site sequence
ggagtgcagtgtgcagtggt

SEQ ID NO: 2170 - DNA, 20 bp, Artificial
  B2M gRNA target site sequence
agtgtgcagtggtgagatct

SEQ ID NO: 2171 - DNA, 20 bp, Artificial
  B2M gRNA target site sequence
tcactgcaacctccgcctcc

SEQ ID NO: 2172 - DNA, 20 bp, Artificial
  B2M gRNA target site sequence
cactgcaacctccgcctcct

SEQ ID NO: 2173 - DNA, 20 bp, Artificial
  B2M gRNA target site sequence
aacctccgcctcctgggttc

SEQ ID NO: 2174 - DNA, 20 bp, Artificial
  B2M gRNA target site sequence
tcctgggttcaagtgattcc

SEQ ID NO: 2175 - DNA, 20 bp, Artificial
  B2M gRNA target site sequence
cctgggttcaagtgattcct

SEQ ID NO: 2176 - DNA, 20 bp, Artificial
  B2M gRNA target site sequence
tcaagtgattcctgggacta

SEQ ID NO: 2177 - DNA, 20 bp, Artificial
  B2M gRNA target site sequence
caagtgattcctgggactac

SEQ ID NO: 2178 - DNA, 20 bp, Artificial
  B2M gRNA target site sequence
caggcacacaccaccatgcc

SEQ ID NO: 2179 - DNA, 20 bp, Artificial
  B2M gRNA target site sequence
ctggttaatttttgtatttt

SEQ ID NO: 2180 - DNA, 20 bp, Artificial
  B2M gRNA target site sequence
gttaatttttgtattttcag

SEQ ID NO: 2181 - DNA, 20 bp, Artificial
  B2M gRNA target site sequence
taatttttgtattttcagta

SEQ ID NO: 2182 - DNA, 20 bp, Artificial
  B2M gRNA target site sequence
ttttgtattttcagtagaga

SEQ ID NO: 2183 - DNA, 20 bp, Artificial
  B2M gRNA target site sequence
tttgtattttcagtagagac

SEQ ID NO: 2184 - DNA, 20 bp, Artificial
  B2M gRNA target site sequence
gagacgggatttcaccatgt

SEQ ID NO: 2185 - DNA, 20 bp, Artificial
  B2M gRNA target site sequence
cgggatttcaccatgttggc

SEQ ID NO: 2186 - DNA, 20 bp, Artificial
  B2M gRNA target site sequence
gggatttcaccatgttggcc

SEQ ID NO: 2187 - DNA, 20 bp, Artificial
  B2M gRNA target site sequence
tttcaccatgttggccaggc

SEQ ID NO: 2188 - DNA, 20 bp, Artificial
  B2M gRNA target site sequence
ggtcttgaactcccaacttc

SEQ ID NO: 2189 - DNA, 20 bp, Artificial
  B2M gRNA target site sequence
aactcccaacttcaagtgat

SEQ ID NO: 2190 - DNA, 20 bp, Artificial
  B2M gRNA target site sequence
ttcaagtgatcagcctgcct

SEQ ID NO: 2191 - DNA, 20 bp, Artificial
  B2M gRNA target site sequence
cagcctgccttggcctccca

SEQ ID NO: 2192 - DNA, 20 bp, Artificial
  B2M gRNA target site sequence
gccttggcctcccaaagtgt

SEQ ID NO: 2193 - DNA, 20 bp, Artificial
  B2M gRNA target site sequence
ccttggcctcccaaagtgtt

SEQ ID NO: 2194 - DNA, 20 bp, Artificial
  B2M gRNA target site sequence
ctcccaaagtgttgggatta

SEQ ID NO: 2195 - DNA, 20 bp, Artificial
  B2M gRNA target site sequence
tcccaaagtgttgggattac

SEQ ID NO: 2196 - DNA, 20 bp, Artificial
  B2M gRNA target site sequence
agtgttgggattacaggcac

SEQ ID NO: 2197 - DNA, 20 bp, Artificial
  B2M gRNA target site sequence
ccaccgtgcccaaccaaccc

SEQ ID NO: 2198 - DNA, 20 bp, Artificial
  B2M gRNA target site sequence
caccgtgcccaaccaaccca

SEQ ID NO: 2199 - DNA, 20 bp, Artificial
  B2M gRNA target site sequence
aaaacctctttatttctgct

SEQ ID NO: 2200 - DNA, 20 bp, Artificial
  B2M gRNA target site sequence
aaacctctttatttctgctg

SEQ ID NO: 2201 - DNA, 20 bp, Artificial
  B2M gRNA target site sequence
tctgctgaggttttatatgc

SEQ ID NO: 2202 - DNA, 20 bp, Artificial
  B2M gRNA target site sequence
gactttgtacctaatttcat

SEQ ID NO: 2203 - DNA, 20 bp, Artificial
  B2M gRNA target site sequence
atttcatgagctaaaaaaca

SEQ ID NO: 2204 - DNA, 20 bp, Artificial
  B2M gRNA target site sequence
aacaaaacctaaatgcatac

SEQ ID NO: 2205 - DNA, 20 bp, Artificial
  B2M gRNA target site sequence
caaaacctaaatgcatacaa

SEQ ID NO: 2206 - DNA, 20 bp, Artificial
  B2M gRNA target site sequence
acctaaatgcatacaagagc

SEQ ID NO: 2207 - DNA, 20 bp, Artificial
  B2M gRNA target site sequence
gagctggcaaataccttaaa

SEQ ID NO: 2208 - DNA, 20 bp, Artificial
  B2M gRNA target site sequence
ggcaaataccttaaatggtt

SEQ ID NO: 2209 - DNA, 20 bp, Artificial
  B2M gRNA target site sequence
aataccttaaatggttgagt

SEQ ID NO: 2210 - DNA, 20 bp, Artificial
  B2M gRNA target site sequence
ttggacccgataaaatacaa

SEQ ID NO: 2211 - DNA, 20 bp, Artificial
  B2M gRNA target site sequence
tggacccgataaaatacaac

SEQ ID NO: 2212 - DNA, 20 bp, Artificial
  B2M gRNA target site sequence
ggacccgataaaatacaaca

SEQ ID NO: 2213 - DNA, 20 bp, Artificial
  B2M gRNA target site sequence
ccgataaaatacaacaggga

SEQ ID NO: 2214 - DNA, 20 bp, Artificial
  B2M gRNA target site sequence
cgataaaatacaacagggat

SEQ ID NO: 2215 - DNA, 20 bp, Artificial
  B2M gRNA target site sequence
aaaatacaacagggataggt

SEQ ID NO: 2216 - DNA, 20 bp, Artificial
  B2M gRNA target site sequence
aaatacaacagggataggtg

SEQ ID NO: 2217 - DNA, 20 bp, Artificial
  B2M gRNA target site sequence
acagggataggtgaggacta

SEQ ID NO: 2218 - DNA, 20 bp, Artificial
  B2M gRNA target site sequence
taggtgaggactatggcaaa

SEQ ID NO: 2219 - DNA, 20 bp, Artificial
  B2M gRNA target site sequence
aggtgaggactatggcaaat

SEQ ID NO: 2220 - DNA, 20 bp, Artificial
  B2M gRNA target site sequence
gaggactatggcaaatggga

SEQ ID NO: 2221 - DNA, 20 bp, Artificial
  B2M gRNA target site sequence
tactttccattatgatcaaa

SEQ ID NO: 2222 - DNA, 20 bp, Artificial
  B2M gRNA target site sequence
ctttccattatgatcaaatg

SEQ ID NO: 2223 - DNA, 20 bp, Artificial
  B2M gRNA target site sequence
aaatggagtaatgcatgtga

SEQ ID NO: 2224 - DNA, 20 bp, Artificial
  B2M gRNA target site sequence
tggagtaatgcatgtgacag

SEQ ID NO: 2225 - DNA, 20 bp, Artificial
  B2M gRNA target site sequence
ggagtaatgcatgtgacagt

SEQ ID NO: 2226 - DNA, 20 bp, Artificial
  B2M gRNA target site sequence
agtgggatttgcgttttaat

SEQ ID NO: 2227 - DNA, 20 bp, Artificial
  B2M gRNA target site sequence
tgcgttttaattagcatcca

SEQ ID NO: 2228 - DNA, 20 bp, Artificial
  B2M gRNA target site sequence
gcgttttaattagcatccac

SEQ ID NO: 2229 - DNA, 20 bp, Artificial
  B2M gRNA target site sequence
cacaggtgattgctgtaaac

SEQ ID NO: 2230 - DNA, 20 bp, Artificial
  B2M gRNA target site sequence
ggtgattgctgtaaactagc

SEQ ID NO: 2231 - DNA, 20 bp, Artificial
  B2M gRNA target site sequence
gtgattgctgtaaactagcc

SEQ ID NO: 2232 - DNA, 20 bp, Artificial
  B2M gRNA target site sequence
ttgctgtaaactagccaggt

SEQ ID NO: 2233 - DNA, 20 bp, Artificial
  B2M gRNA target site sequence
tgctgtaaactagccaggtt

SEQ ID NO: 2234 - DNA, 20 bp, Artificial
  B2M gRNA target site sequence
gaatatattgcctaatgttt

SEQ ID NO: 2235 - DNA, 20 bp, Artificial
  B2M gRNA target site sequence
attgcctaatgtttcagaaa

SEQ ID NO: 2236 - DNA, 20 bp, Artificial
  B2M gRNA target site sequence
gaaacagtactttccaaaat

SEQ ID NO: 2237 - DNA, 20 bp, Artificial
  B2M gRNA target site sequence
aacagtactttccaaaatga

SEQ ID NO: 2238 - DNA, 20 bp, Artificial
  B2M gRNA target site sequence
acagtactttccaaaatgag

SEQ ID NO: 2239 - DNA, 20 bp, Artificial
  B2M gRNA target site sequence
tccaaaatgagaggcatgac

SEQ ID NO: 2240 - DNA, 20 bp, Artificial
  B2M gRNA target site sequence
aggcatgactagaccatcca

SEQ ID NO: 2241 - DNA, 20 bp, Artificial
  B2M gRNA target site sequence
ggcatgactagaccatccat

SEQ ID NO: 2242 - DNA, 20 bp, Artificial
  B2M gRNA target site sequence
gcatgactagaccatccatg

SEQ ID NO: 2243 - DNA, 20 bp, Artificial
  B2M gRNA target site sequence
tgactagaccatccatgggg

SEQ ID NO: 2244 - DNA, 20 bp, Artificial
  B2M gRNA target site sequence
ctagaccatccatggggaag

SEQ ID NO: 2245 - DNA, 20 bp, Artificial
  B2M gRNA target site sequence
tagaccatccatggggaagt

SEQ ID NO: 2246 - DNA, 20 bp, Artificial
  B2M gRNA target site sequence
accatccatggggaagtggg

SEQ ID NO: 2247 - DNA, 20 bp, Artificial
  B2M gRNA target site sequence
tatatttttcattgaaaatg

SEQ ID NO: 2248 - DNA, 20 bp, Artificial
  B2M gRNA target site sequence
tatttttcattgaaaatgaa

SEQ ID NO: 2249 - DNA, 20 bp, Artificial
  B2M gRNA target site sequence
ttttcattgaaaatgaagag

SEQ ID NO: 2250 - DNA, 20 bp, Artificial
  B2M gRNA target site sequence
ttgaaaatgaagagaagtgt

SEQ ID NO: 2251 - DNA, 20 bp, Artificial
  B2M gRNA target site sequence
tgttagtgctactaaatata

SEQ ID NO: 2252 - DNA, 20 bp, Artificial
  B2M gRNA target site sequence
cttttaaatacacttatatt

SEQ ID NO: 2253 - DNA, 20 bp, Artificial
  B2M gRNA target site sequence
ttttaaatacacttatattc

SEQ ID NO: 2254 - DNA, 20 bp, Artificial
  B2M gRNA target site sequence
tttaaatacacttatattca

SEQ ID NO: 2255 - DNA, 20 bp, Artificial
  B2M gRNA target site sequence
tcagggtacatgatcactaa

SEQ ID NO: 2256 - DNA, 20 bp, Artificial
  B2M gRNA target site sequence
cagggtacatgatcactaaa

SEQ ID NO: 2257 - DNA, 20 bp, Artificial
  B2M gRNA target site sequence
ggtacatgatcactaaaagg

SEQ ID NO: 2258 - DNA, 20 bp, Artificial
  B2M gRNA target site sequence
ggcagctactcctccttgtc

SEQ ID NO: 2259 - DNA, 20 bp, Artificial
  B2M gRNA target site sequence
gcagctactcctccttgtct

SEQ ID NO: 2260 - DNA, 20 bp, Artificial
  B2M gRNA target site sequence
agctactcctccttgtctgg

SEQ ID NO: 2261 - DNA, 20 bp, Artificial
  B2M gRNA target site sequence
gctactcctccttgtctggg

SEQ ID NO: 2262 - DNA, 20 bp, Artificial
  B2M gRNA target site sequence
cctccttgtctgggaggctg

SEQ ID NO: 2263 - DNA, 20 bp, Artificial
  B2M gRNA target site sequence
ctccttgtctgggaggctgt

SEQ ID NO: 2264 - DNA, 20 bp, Artificial
  B2M gRNA target site sequence
tccttgtctgggaggctgtg

SEQ ID NO: 2265 - DNA, 20 bp, Artificial
  B2M gRNA target site sequence
cttgtctgggaggctgtggg

SEQ ID NO: 2266 - DNA, 20 bp, Artificial
  B2M gRNA target site sequence
gtctgggaggctgtggggag

SEQ ID NO: 2267 - DNA, 20 bp, Artificial
  B2M gRNA target site sequence
tctgggaggctgtggggaga

SEQ ID NO: 2268 - DNA, 20 bp, Artificial
  B2M gRNA target site sequence
tgggaggctgtggggagaag

SEQ ID NO: 2269 - DNA, 20 bp, Artificial
  B2M gRNA target site sequence
gggaggctgtggggagaagg

SEQ ID NO: 2270 - DNA, 20 bp, Artificial
  B2M gRNA target site sequence
gaggctgtggggagaaggag

SEQ ID NO: 2271 - DNA, 20 bp, Artificial
  B2M gRNA target site sequence
gtggggagaaggaggagtac

SEQ ID NO: 2272 - DNA, 20 bp, Artificial
  B2M gRNA target site sequence
tggggagaaggaggagtacc

SEQ ID NO: 2273 - DNA, 20 bp, Artificial
  B2M gRNA target site sequence
gagtaccaggccaccttgac

SEQ ID NO: 2274 - DNA, 20 bp, Artificial
  B2M gRNA target site sequence
cttgaccagatatatctctc

SEQ ID NO: 2275 - DNA, 20 bp, Artificial
  B2M gRNA target site sequence
tctagaaacaccctatcatt

SEQ ID NO: 2276 - DNA, 20 bp, Artificial
  B2M gRNA target site sequence
ctagaaacaccctatcatta

SEQ ID NO: 2277 - DNA, 20 bp, Artificial
  B2M gRNA target site sequence
aaacaccctatcattaagga

SEQ ID NO: 2278 - DNA, 20 bp, Artificial
  B2M gRNA target site sequence
aacaccctatcattaaggaa

SEQ ID NO: 2279 - DNA, 20 bp, Artificial
  B2M gRNA target site sequence
tatcattaaggaaaggctac

SEQ ID NO: 2280 - DNA, 20 bp, Artificial
  B2M gRNA target site sequence
gaaaggctactagccccatc

SEQ ID NO: 2281 - DNA, 20 bp, Artificial
  B2M gRNA target site sequence
aaggctactagccccatcaa

SEQ ID NO: 2282 - DNA, 20 bp, Artificial
  B2M gRNA target site sequence
aggctactagccccatcaag

SEQ ID NO: 2283 - DNA, 20 bp, Artificial
  B2M gRNA target site sequence
ctactagccccatcaagagg

SEQ ID NO: 2284 - DNA, 20 bp, Artificial
  B2M gRNA target site sequence
agccccatcaagaggtggat

SEQ ID NO: 2285 - DNA, 20 bp, Artificial
  B2M gRNA target site sequence
gccccatcaagaggtggatt

SEQ ID NO: 2286 - DNA, 20 bp, Artificial
  B2M gRNA target site sequence
ccccatcaagaggtggattg

SEQ ID NO: 2287 - DNA, 20 bp, Artificial
  B2M gRNA target site sequence
gtggattggggaatctaatg

SEQ ID NO: 2288 - DNA, 20 bp, Artificial
  B2M gRNA target site sequence
gatttttttcataacattaa

SEQ ID NO: 2289 - DNA, 20 bp, Artificial
  B2M gRNA target site sequence
ttttcataacattaaaagct

SEQ ID NO: 2290 - DNA, 20 bp, Artificial
  B2M gRNA target site sequence
ttcataacattaaaagctaa

SEQ ID NO: 2291 - DNA, 20 bp, Artificial
  B2M gRNA target site sequence
cataacattaaaagctaaga

SEQ ID NO: 2292 - DNA, 20 bp, Artificial
  B2M gRNA target site sequence
taagagagctctttgcatct

SEQ ID NO: 2293 - DNA, 20 bp, Artificial
  B2M gRNA target site sequence
gcatctgagcttctaataat

SEQ ID NO: 2294 - DNA, 20 bp, Artificial
  B2M gRNA target site sequence
taagaacatattaaatgcct

SEQ ID NO: 2295 - DNA, 20 bp, Artificial
  B2M gRNA target site sequence
aagaacatattaaatgcctc

SEQ ID NO: 2296 - DNA, 20 bp, Artificial
  B2M gRNA target site sequence
agaacatattaaatgcctca

SEQ ID NO: 2297 - DNA, 20 bp, Artificial
  B2M gRNA target site sequence
atattaaatgcctcagggat

SEQ ID NO: 2298 - DNA, 20 bp, Artificial
  B2M gRNA target site sequence
attaaatgcctcagggatca

SEQ ID NO: 2299 - DNA, 20 bp, Artificial
  B2M gRNA target site sequence
atgcctcagggatcagagca

SEQ ID NO: 2300 - DNA, 20 bp, Artificial
  B2M gRNA target site sequence
gagcacagattcatcctgcc

SEQ ID NO: 2301 - DNA, 20 bp, Artificial
  B2M gRNA target site sequence
ctgcctggaactctctgttt

SEQ ID NO: 2302 - DNA, 20 bp, Artificial
  B2M gRNA target site sequence
tgcctggaactctctgtttg

SEQ ID NO: 2303 - DNA, 20 bp, Artificial
  B2M gRNA target site sequence
gcctggaactctctgtttga

SEQ ID NO: 2304 - DNA, 20 bp, Artificial
  B2M gRNA target site sequence
tggaactctctgtttgaggg

SEQ ID NO: 2305 - DNA, 20 bp, Artificial
  B2M gRNA target site sequence
ggaactctctgtttgaggga

SEQ ID NO: 2306 - DNA, 20 bp, Artificial
  B2M gRNA target site sequence
actctctgtttgagggaagg

SEQ ID NO: 2307 - DNA, 20 bp, Artificial
  B2M gRNA target site sequence
tctgtttgagggaaggcggc

SEQ ID NO: 2308 - DNA, 20 bp, Artificial
  B2M gRNA target site sequence
ggaaggcggcaagattttgt

SEQ ID NO: 2309 - DNA, 20 bp, Artificial
  B2M gRNA target site sequence
aaggcggcaagattttgtga

SEQ ID NO: 2310 - DNA, 20 bp, Artificial
  B2M gRNA target site sequence
gcatcactgtaatcttttct

SEQ ID NO: 2311 - DNA, 20 bp, Artificial
  B2M gRNA target site sequence
tcactgtaatcttttctaag

SEQ ID NO: 2312 - DNA, 20 bp, Artificial
  B2M gRNA target site sequence
actgtaatcttttctaagaa

SEQ ID NO: 2313 - DNA, 20 bp, Artificial
  B2M gRNA target site sequence
ctgtaatcttttctaagaag

SEQ ID NO: 2314 - DNA, 20 bp, Artificial
  B2M gRNA target site sequence
atcttttctaagaagaggac

SEQ ID NO: 2315 - DNA, 20 bp, Artificial
  B2M gRNA target site sequence
tctaagaagaggacaagtat

SEQ ID NO: 2316 - DNA, 20 bp, Artificial
  B2M gRNA target site sequence
agaagaggacaagtatcaga

SEQ ID NO: 2317 - DNA, 20 bp, Artificial
  B2M gRNA target site sequence
gaagaggacaagtatcagac

SEQ ID NO: 2318 - DNA, 20 bp, Artificial
  B2M gRNA target site sequence
aggacaagtatcagacaggc

SEQ ID NO: 2319 - DNA, 20 bp, Artificial
  B2M gRNA target site sequence
ggacaagtatcagacaggct

SEQ ID NO: 2320 - DNA, 20 bp, Artificial
  B2M gRNA target site sequence
agacaggctgggtttgaatt

SEQ ID NO: 2321 - DNA, 20 bp, Artificial
  B2M gRNA target site sequence
gacaggctgggtttgaattt

SEQ ID NO: 2322 - DNA, 20 bp, Artificial
  B2M gRNA target site sequence
ggtttgaatttgggctcaac

SEQ ID NO: 2323 - DNA, 20 bp, Artificial
  B2M gRNA target site sequence
atttgggctcaaccagttac

SEQ ID NO: 2324 - DNA, 20 bp, Artificial
  B2M gRNA target site sequence
gttactggctttatgacttt

SEQ ID NO: 2325 - DNA, 20 bp, Artificial
  B2M gRNA target site sequence
tactggctttatgacttttg

SEQ ID NO: 2326 - DNA, 20 bp, Artificial
  B2M gRNA target site sequence
ctggctttatgacttttgga

SEQ ID NO: 2327 - DNA, 20 bp, Artificial
  B2M gRNA target site sequence
tgacttttggagagttattt

SEQ ID NO: 2328 - DNA, 20 bp, Artificial
  B2M gRNA target site sequence
gaaaaattaatttatgccca

SEQ ID NO: 2329 - DNA, 20 bp, Artificial
  B2M gRNA target site sequence
acaaaaacaaaacccacaca

SEQ ID NO: 2330 - DNA, 20 bp, Artificial
  B2M gRNA target site sequence
caaaaacaaaacccacacac

SEQ ID NO: 2331 - DNA, 20 bp, Artificial
  B2M gRNA target site sequence
aacaaaacccacacacaggt

SEQ ID NO: 2332 - DNA, 20 bp, Artificial
  B2M gRNA target site sequence
caaaacccacacacaggtca

SEQ ID NO: 2333 - DNA, 20 bp, Artificial
  B2M gRNA target site sequence
aaaacccacacacaggtcag

SEQ ID NO: 2334 - DNA, 20 bp, Artificial
  B2M gRNA target site sequence
aacccacacacaggtcagag

SEQ ID NO: 2335 - DNA, 20 bp, Artificial
  B2M gRNA target site sequence
acccacacacaggtcagagg

SEQ ID NO: 2336 - DNA, 20 bp, Artificial
  B2M gRNA target site sequence
cacaggtcagaggaggaaaa

SEQ ID NO: 2337 - DNA, 20 bp, Artificial
  B2M gRNA target site sequence
agaggaggaaaatagacctt

SEQ ID NO: 2338 - DNA, 20 bp, Artificial
  B2M gRNA target site sequence
aggaggaaaatagaccttca

SEQ ID NO: 2339 - DNA, 20 bp, Artificial
  B2M gRNA target site sequence
ggaggaaaatagaccttcag

SEQ ID NO: 2340 - DNA, 20 bp, Artificial
  B2M gRNA target site sequence
tcatcattacatgtttcttg

SEQ ID NO: 2341 - DNA, 20 bp, Artificial
  B2M gRNA target site sequence
atgtttcttgtggtatcttc

SEQ ID NO: 2342 - DNA, 20 bp, Artificial
  B2M gRNA target site sequence
cttgtggtatcttccagaaa

SEQ ID NO: 2343 - DNA, 20 bp, Artificial
  B2M gRNA target site sequence
ttccagaaatggtctatgca

SEQ ID NO: 2344 - DNA, 20 bp, Artificial
  B2M gRNA target site sequence
atgcatggcatgtattactt

SEQ ID NO: 2345 - DNA, 20 bp, Artificial
  B2M gRNA target site sequence
actttggaaattttcaaaat

SEQ ID NO: 2346 - DNA, 20 bp, Artificial
  B2M gRNA target site sequence
taagatttttttttaaatat

SEQ ID NO: 2347 - DNA, 20 bp, Artificial
  B2M gRNA target site sequence
aaaatgacatctaacataac

SEQ ID NO: 2348 - DNA, 20 bp, Artificial
  B2M gRNA target site sequence
ctaacataaccagcaaatac

SEQ ID NO: 2349 - DNA, 20 bp, Artificial
  B2M gRNA target site sequence
taaccagcaaataccagtaa

SEQ ID NO: 2350 - DNA, 20 bp, Artificial
  B2M gRNA target site sequence
ccagcaaataccagtaatgg

SEQ ID NO: 2351 - DNA, 20 bp, Artificial
  B2M gRNA target site sequence
tgctttcgatcatgttttgc

SEQ ID NO: 2352 - DNA, 20 bp, Artificial
  B2M gRNA target site sequence
ctttcgatcatgttttgcca

SEQ ID NO: 2353 - DNA, 20 bp, Artificial
  B2M gRNA target site sequence
tttcgatcatgttttgccag

SEQ ID NO: 2354 - DNA, 20 bp, Artificial
  B2M gRNA target site sequence
atcatgttttgccagaggaa

SEQ ID NO: 2355 - DNA, 20 bp, Artificial
  B2M gRNA target site sequence
tcatgttttgccagaggaaa

SEQ ID NO: 2356 - DNA, 20 bp, Artificial
  B2M gRNA target site sequence
gttttgccagaggaaaaggt

SEQ ID NO: 2357 - DNA, 20 bp, Artificial
  B2M gRNA target site sequence
gaggaaaaggtgagcgcgct

SEQ ID NO: 2358 - DNA, 20 bp, Artificial
  B2M gRNA target site sequence
gagcgcgcttagtgtattgc

SEQ ID NO: 2359 - DNA, 20 bp, Artificial
  B2M gRNA target site sequence
agcgcgcttagtgtattgcc

SEQ ID NO: 2360 - DNA, 20 bp, Artificial
  B2M gRNA target site sequence
ttagtgtattgccaggtact

SEQ ID NO: 2361 - DNA, 20 bp, Artificial
  B2M gRNA target site sequence
tgtattgccaggtacttaga

SEQ ID NO: 2362 - DNA, 20 bp, Artificial
  B2M gRNA target site sequence
caggtacttagaaagtgctc

SEQ ID NO: 2363 - DNA, 20 bp, Artificial
  B2M gRNA target site sequence
tagaaagtgctcaagatctc

SEQ ID NO: 2364 - DNA, 20 bp, Artificial
  B2M gRNA target site sequence
aagatctctggcgtcctcaa

SEQ ID NO: 2365 - DNA, 20 bp, Artificial
  B2M gRNA target site sequence
tctggcgtcctcaacagtct

SEQ ID NO: 2366 - DNA, 20 bp, Artificial
  B2M gRNA target site sequence
aacagtcttggtaaccatct

SEQ ID NO: 2367 - DNA, 20 bp, Artificial
  B2M gRNA target site sequence
tcttggattatctttattaa

SEQ ID NO: 2368 - DNA, 20 bp, Artificial
  B2M gRNA target site sequence
tatctttattaatggtttta

SEQ ID NO: 2369 - DNA, 20 bp, Artificial
  B2M gRNA target site sequence
tttttttttttttctttttt

SEQ ID NO: 2370 - DNA, 20 bp, Artificial
  B2M gRNA target site sequence
tttttttttttcttttttga

SEQ ID NO: 2371 - DNA, 20 bp, Artificial
  B2M gRNA target site sequence
tttttttcttttttgagaga

SEQ ID NO: 2372 - DNA, 20 bp, Artificial
  B2M gRNA target site sequence
ttttttcttttttgagagac

SEQ ID NO: 2373 - DNA, 20 bp, Artificial
  B2M gRNA target site sequence
tttttcttttttgagagaca

SEQ ID NO: 2374 - DNA, 20 bp, Artificial
  B2M gRNA target site sequence
tctcgctctgttgcccacgc

SEQ ID NO: 2375 - DNA, 20 bp, Artificial
  B2M gRNA target site sequence
tcgctctgttgcccacgctg

SEQ ID NO: 2376 - DNA, 20 bp, Artificial
  B2M gRNA target site sequence
ttgcccacgctggagtgcac

SEQ ID NO: 2377 - DNA, 20 bp, Artificial
  B2M gRNA target site sequence
ggagtgcactggcgccatga

SEQ ID NO: 2378 - DNA, 20 bp, Artificial
  B2M gRNA target site sequence
ctggcgccatgatagctcaa

SEQ ID NO: 2379 - DNA, 20 bp, Artificial
  B2M gRNA target site sequence
ccatgatagctcaaaagcct

SEQ ID NO: 2380 - DNA, 20 bp, Artificial
  B2M gRNA target site sequence
tagctcaaaagcctaagctc

SEQ ID NO: 2381 - DNA, 20 bp, Artificial
  B2M gRNA target site sequence
gctcaaaagcctaagctcaa

SEQ ID NO: 2382 - DNA, 20 bp, Artificial
  B2M gRNA target site sequence
ctcaagagatcctcccgcct

SEQ ID NO: 2383 - DNA, 20 bp, Artificial
  B2M gRNA target site sequence
gatcctcccgcctcagccac

SEQ ID NO: 2384 - DNA, 20 bp, Artificial
  B2M gRNA target site sequence
tcctcccgcctcagccaccg

SEQ ID NO: 2385 - DNA, 20 bp, Artificial
  B2M gRNA target site sequence
tcccgcctcagccaccggag

SEQ ID NO: 2386 - DNA, 20 bp, Artificial
  B2M gRNA target site sequence
gcctcagccaccggagcagc

SEQ ID NO: 2387 - DNA, 20 bp, Artificial
  B2M gRNA target site sequence
cctcagccaccggagcagct

SEQ ID NO: 2388 - DNA, 20 bp, Artificial
  B2M gRNA target site sequence
caccggagcagctgggacca

SEQ ID NO: 2389 - DNA, 20 bp, Artificial
  B2M gRNA target site sequence
accggagcagctgggaccac

SEQ ID NO: 2390 - DNA, 20 bp, Artificial
  B2M gRNA target site sequence
gcagctgggaccacaggcac

SEQ ID NO: 2391 - DNA, 20 bp, Artificial
  B2M gRNA target site sequence
caggcacgagccaccacacc

SEQ ID NO: 2392 - DNA, 20 bp, Artificial
  B2M gRNA target site sequence
atttttgttattattttttg

SEQ ID NO: 2393 - DNA, 20 bp, Artificial
  B2M gRNA target site sequence
ttttgttattattttttgta

SEQ ID NO: 2394 - DNA, 20 bp, Artificial
  B2M gRNA target site sequence
ttattattttttgtagagac

SEQ ID NO: 2395 - DNA, 20 bp, Artificial
  B2M gRNA target site sequence
tattattttttgtagagacc

SEQ ID NO: 2396 - DNA, 20 bp, Artificial
  B2M gRNA target site sequence
gagaccaggcttcaccatgt

SEQ ID NO: 2397 - DNA, 20 bp, Artificial
  B2M gRNA target site sequence
ccaggcttcaccatgttggc

SEQ ID NO: 2398 - DNA, 20 bp, Artificial
  B2M gRNA target site sequence
caggcttcaccatgttggcc

SEQ ID NO: 2399 - DNA, 20 bp, Artificial
  B2M gRNA target site sequence
cttcaccatgttggccaggc

SEQ ID NO: 2400 - DNA, 20 bp, Artificial
  B2M gRNA target site sequence
ggccaggctggtctcaacta

SEQ ID NO: 2401 - DNA, 20 bp, Artificial
  B2M gRNA target site sequence
tggtctcaactacggacctc

SEQ ID NO: 2402 - DNA, 20 bp, Artificial
  B2M gRNA target site sequence
ctcaagccatcctcccgcct

SEQ ID NO: 2403 - DNA, 20 bp, Artificial
  B2M gRNA target site sequence
cctcccgcctcggcctccct

SEQ ID NO: 2404 - DNA, 20 bp, Artificial
  B2M gRNA target site sequence
gcctcggcctccctaagtgc

SEQ ID NO: 2405 - DNA, 20 bp, Artificial
  B2M gRNA target site sequence
cctcggcctccctaagtgct

SEQ ID NO: 2406 - DNA, 20 bp, Artificial
  B2M gRNA target site sequence
ctccctaagtgctgggatta

SEQ ID NO: 2407 - DNA, 20 bp, Artificial
  B2M gRNA target site sequence
tccctaagtgctgggattac

SEQ ID NO: 2408 - DNA, 20 bp, Artificial
  B2M gRNA target site sequence
agtgctgggattacaggcgt

SEQ ID NO: 2409 - DNA, 20 bp, Artificial
  B2M gRNA target site sequence
cctcatgttttcaaaaccga

SEQ ID NO: 2410 - DNA, 20 bp, Artificial
  B2M gRNA target site sequence
atgttttcaaaaccgaaagt

SEQ ID NO: 2411 - DNA, 20 bp, Artificial
  B2M gRNA target site sequence
gttttcaaaaccgaaagtaa

SEQ ID NO: 2412 - DNA, 20 bp, Artificial
  B2M gRNA target site sequence
ttttcaaaaccgaaagtaag

SEQ ID NO: 2413 - DNA, 20 bp, Artificial
  B2M gRNA target site sequence
aaaaccgaaagtaagaggca

SEQ ID NO: 2414 - DNA, 20 bp, Artificial
  B2M gRNA target site sequence
gtaagaggcacagtacatct

SEQ ID NO: 2415 - DNA, 20 bp, Artificial
  B2M gRNA target site sequence
cagtacatcttggaaacaac

SEQ ID NO: 2416 - DNA, 20 bp, Artificial
  B2M gRNA target site sequence
agtacatcttggaaacaacc

SEQ ID NO: 2417 - DNA, 20 bp, Artificial
  B2M gRNA target site sequence
atcttggaaacaaccaggca

SEQ ID NO: 2418 - DNA, 20 bp, Artificial
  B2M gRNA target site sequence
cttggaaacaaccaggcaaa

SEQ ID NO: 2419 - DNA, 20 bp, Artificial
  B2M gRNA target site sequence
aacaaccaggcaaagagcca

SEQ ID NO: 2420 - DNA, 20 bp, Artificial
  B2M gRNA target site sequence
caaccaggcaaagagccaaa

SEQ ID NO: 2421 - DNA, 20 bp, Artificial
  B2M gRNA target site sequence
aaccaggcaaagagccaaag

SEQ ID NO: 2422 - DNA, 20 bp, Artificial
  B2M gRNA target site sequence
caggcaaagagccaaagagg

SEQ ID NO: 2423 - DNA, 20 bp, Artificial
  B2M gRNA target site sequence
gaggaagccctctgtacgaa

SEQ ID NO: 2424 - DNA, 20 bp, Artificial
  B2M gRNA target site sequence
ccctctgtacgaaaagacca

SEQ ID NO: 2425 - DNA, 20 bp, Artificial
  B2M gRNA target site sequence
cctctgtacgaaaagaccac

SEQ ID NO: 2426 - DNA, 20 bp, Artificial
  B2M gRNA target site sequence
ctctgtacgaaaagaccaca

SEQ ID NO: 2427 - DNA, 20 bp, Artificial
  B2M gRNA target site sequence
accacagggcccatgccgcc

SEQ ID NO: 2428 - DNA, 20 bp, Artificial
  B2M gRNA target site sequence
ccatgccgcccagtttgctc

SEQ ID NO: 2429 - DNA, 20 bp, Artificial
  B2M gRNA target site sequence
atgccgcccagtttgctctg

SEQ ID NO: 2430 - DNA, 20 bp, Artificial
  B2M gRNA target site sequence
ttgctctggagaatctcacg

SEQ ID NO: 2431 - DNA, 20 bp, Artificial
  B2M gRNA target site sequence
ctctggagaatctcacgcag

SEQ ID NO: 2432 - DNA, 20 bp, Artificial
  B2M gRNA target site sequence
tctggagaatctcacgcaga

SEQ ID NO: 2433 - DNA, 20 bp, Artificial
  B2M gRNA target site sequence
ggagaatctcacgcagaagg

SEQ ID NO: 2434 - DNA, 20 bp, Artificial
  B2M gRNA target site sequence
gagaatctcacgcagaaggc

SEQ ID NO: 2435 - DNA, 20 bp, Artificial
  B2M gRNA target site sequence
aaaaaaaaatgcacgaatta

SEQ ID NO: 2436 - DNA, 20 bp, Artificial
  B2M gRNA target site sequence
aatgcacgaattacagccaa

SEQ ID NO: 2437 - DNA, 20 bp, Artificial
  B2M gRNA target site sequence
atgcacgaattacagccaaa

SEQ ID NO: 2438 - DNA, 20 bp, Artificial
  B2M gRNA target site sequence
aaaggcatgcgctcccgcaa

SEQ ID NO: 2439 - DNA, 20 bp, Artificial
  B2M gRNA target site sequence
atgcgctcccgcaaaagccc

SEQ ID NO: 2440 - DNA, 20 bp, Artificial
  B2M gRNA target site sequence
gctcccgcaaaagccctggt

SEQ ID NO: 2441 - DNA, 20 bp, Artificial
  B2M gRNA target site sequence
ctcccgcaaaagccctggtt

SEQ ID NO: 2442 - DNA, 20 bp, Artificial
  B2M gRNA target site sequence
catttatcccctgtgtaatt

SEQ ID NO: 2443 - DNA, 20 bp, Artificial
  B2M gRNA target site sequence
aattaagtttcttaaaatct

SEQ ID NO: 2444 - DNA, 20 bp, Artificial
  B2M gRNA target site sequence
ttcttaaaatctcggtgcct

SEQ ID NO: 2445 - DNA, 20 bp, Artificial
  B2M gRNA target site sequence
gccttagtttcttcatctgt

SEQ ID NO: 2446 - DNA, 20 bp, Artificial
  B2M gRNA target site sequence
cttagtttcttcatctgtga

SEQ ID NO: 2447 - DNA, 20 bp, Artificial
  B2M gRNA target site sequence
ttagtttcttcatctgtgag

SEQ ID NO: 2448 - DNA, 20 bp, Artificial
  B2M gRNA target site sequence
gtttcttcatctgtgagagg

SEQ ID NO: 2449 - DNA, 20 bp, Artificial
  B2M gRNA target site sequence
tcttcatctgtgagaggcag

SEQ ID NO: 2450 - DNA, 20 bp, Artificial
  B2M gRNA target site sequence
tgagaggcagaagataacca

SEQ ID NO: 2451 - DNA, 20 bp, Artificial
  B2M gRNA target site sequence
gaggcagaagataaccatag

SEQ ID NO: 2452 - DNA, 20 bp, Artificial
  B2M gRNA target site sequence
ataaccatagtagttatcta

SEQ ID NO: 2453 - DNA, 20 bp, Artificial
  B2M gRNA target site sequence
accatagtagttatctatgg

SEQ ID NO: 2454 - DNA, 20 bp, Artificial
  B2M gRNA target site sequence
atagtagttatctatggcgg

SEQ ID NO: 2455 - DNA, 20 bp, Artificial
  B2M gRNA target site sequence
tttcaaaattaaatgacgca

SEQ ID NO: 2456 - DNA, 20 bp, Artificial
  B2M gRNA target site sequence
taaatgacgcaaagcacata

SEQ ID NO: 2457 - DNA, 20 bp, Artificial
  B2M gRNA target site sequence
cgcaaagcacataaagtcct

SEQ ID NO: 2458 - DNA, 20 bp, Artificial
  B2M gRNA target site sequence
cacataaagtccttggcaca

SEQ ID NO: 2459 - DNA, 20 bp, Artificial
  B2M gRNA target site sequence
taaagtccttggcacacaga

SEQ ID NO: 2460 - DNA, 20 bp, Artificial
  B2M gRNA target site sequence
acacagaaagatgtcaataa

SEQ ID NO: 2461 - DNA, 20 bp, Artificial
  B2M gRNA target site sequence
cacagaaagatgtcaataac

SEQ ID NO: 2462 - DNA, 20 bp, Artificial
  B2M gRNA target site sequence
agaaagatgtcaataacggg

SEQ ID NO: 2463 - DNA, 20 bp, Artificial
  B2M gRNA target site sequence
tagttcttataattttttaa

SEQ ID NO: 2464 - DNA, 20 bp, Artificial
  B2M gRNA target site sequence
tttttaaaagtgacatgtga

SEQ ID NO: 2465 - DNA, 20 bp, Artificial
  B2M gRNA target site sequence
ttttaaaagtgacatgtgat

SEQ ID NO: 2466 - DNA, 20 bp, Artificial
  B2M gRNA target site sequence
gacatgtgatgggaacaaat

SEQ ID NO: 2467 - DNA, 20 bp, Artificial
  B2M gRNA target site sequence
ttcgaaaccgctttgtatca

SEQ ID NO: 2468 - DNA, 20 bp, Artificial
  B2M gRNA target site sequence
aaccgctttgtatcacagcc

SEQ ID NO: 2469 - DNA, 20 bp, Artificial
  B2M gRNA target site sequence
cgcgtgctgtttcctcccca

SEQ ID NO: 2470 - DNA, 20 bp, Artificial
  B2M gRNA target site sequence
gctgtttcctccccacggtg

SEQ ID NO: 2471 - DNA, 20 bp, Artificial
  B2M gRNA target site sequence
ccccacggtgtggccccaca

SEQ ID NO: 2472 - DNA, 20 bp, Artificial
  B2M gRNA target site sequence
ggtgtggccccacatagacc

SEQ ID NO: 2473 - DNA, 20 bp, Artificial
  B2M gRNA target site sequence
tgtggccccacatagaccca

SEQ ID NO: 2474 - DNA, 20 bp, Artificial
  B2M gRNA target site sequence
gtggccccacatagacccag

SEQ ID NO: 2475 - DNA, 20 bp, Artificial
  B2M gRNA target site sequence
ccacatagacccagaggtgc

SEQ ID NO: 2476 - DNA, 20 bp, Artificial
  B2M gRNA target site sequence
cacatagacccagaggtgct

SEQ ID NO: 2477 - DNA, 20 bp, Artificial
  B2M gRNA target site sequence
ggtgctaggacatgcgaact

SEQ ID NO: 2478 - DNA, 20 bp, Artificial
  B2M gRNA target site sequence
gctaggacatgcgaacttag

SEQ ID NO: 2479 - DNA, 20 bp, Artificial
  B2M gRNA target site sequence
ctaggacatgcgaacttagc

SEQ ID NO: 2480 - DNA, 20 bp, Artificial
  B2M gRNA target site sequence
atgcgaacttagcgggcgcc

SEQ ID NO: 2481 - DNA, 20 bp, Artificial
  B2M gRNA target site sequence
acttagcgggcgcctagacg

SEQ ID NO: 2482 - DNA, 20 bp, Artificial
  B2M gRNA target site sequence
gggcgcctagacgaagtcca

SEQ ID NO: 2483 - DNA, 20 bp, Artificial
  B2M gRNA target site sequence
agacgaagtccacagctctc

SEQ ID NO: 2484 - DNA, 20 bp, Artificial
  B2M gRNA target site sequence
agtccacagctctccagtct

SEQ ID NO: 2485 - DNA, 20 bp, Artificial
  B2M gRNA target site sequence
gtccacagctctccagtcta

SEQ ID NO: 2486 - DNA, 20 bp, Artificial
  B2M gRNA target site sequence
tccacagctctccagtctaa

SEQ ID NO: 2487 - DNA, 20 bp, Artificial
  B2M gRNA target site sequence
acagctctccagtctaaggg

SEQ ID NO: 2488 - DNA, 20 bp, Artificial
  B2M gRNA target site sequence
gctctccagtctaagggaag

SEQ ID NO: 2489 - DNA, 20 bp, Artificial
  B2M gRNA target site sequence
tctccagtctaagggaagca

SEQ ID NO: 2490 - DNA, 20 bp, Artificial
  B2M gRNA target site sequence
gtctaagggaagcagagccg

SEQ ID NO: 2491 - DNA, 20 bp, Artificial
  B2M gRNA target site sequence
taagggaagcagagccgcag

SEQ ID NO: 2492 - DNA, 20 bp, Artificial
  B2M gRNA target site sequence
ggaagcagagccgcagcaga

SEQ ID NO: 2493 - DNA, 20 bp, Artificial
  B2M gRNA target site sequence
gaagcagagccgcagcagac

SEQ ID NO: 2494 - DNA, 20 bp, Artificial
  B2M gRNA target site sequence
ccgcagcagacaggcttacc

SEQ ID NO: 2495 - DNA, 20 bp, Artificial
  B2M gRNA target site sequence
cgcagcagacaggcttaccc

SEQ ID NO: 2496 - DNA, 20 bp, Artificial
  B2M gRNA target site sequence
tacccgggcgacgcctcccc

SEQ ID NO: 2497 - DNA, 20 bp, Artificial
  B2M gRNA target site sequence
cgacgcctcccccagacccc

SEQ ID NO: 2498 - DNA, 20 bp, Artificial
  B2M gRNA target site sequence
ctccacgcgttcacaaacct

SEQ ID NO: 2499 - DNA, 20 bp, Artificial
  B2M gRNA target site sequence
aaacctcagcgccgcgcctt

SEQ ID NO: 2500 - DNA, 20 bp, Artificial
  B2M gRNA target site sequence
aacctcagcgccgcgccttt

SEQ ID NO: 2501 - DNA, 20 bp, Artificial
  B2M gRNA target site sequence
cagcgccgcgcctttgggac

SEQ ID NO: 2502 - DNA, 20 bp, Artificial
  B2M gRNA target site sequence
agcctacccgtcccccactc

SEQ ID NO: 2503 - DNA, 20 bp, Artificial
  B2M gRNA target site sequence
gtcccccactccagctgcgc

SEQ ID NO: 2504 - DNA, 20 bp, Artificial
  B2M gRNA target site sequence
tcccccactccagctgcgct

SEQ ID NO: 2505 - DNA, 20 bp, Artificial
  B2M gRNA target site sequence
cccccactccagctgcgctg

SEQ ID NO: 2506 - DNA, 20 bp, Artificial
  B2M gRNA target site sequence
ccccactccagctgcgctgg

SEQ ID NO: 2507 - DNA, 20 bp, Artificial
  B2M gRNA target site sequence
ccactccagctgcgctgggg

SEQ ID NO: 2508 - DNA, 20 bp, Artificial
  B2M gRNA target site sequence
tccagctgcgctgggggagc

SEQ ID NO: 2509 - DNA, 20 bp, Artificial
  B2M gRNA target site sequence
cagctgcgctgggggagcca

SEQ ID NO: 2510 - DNA, 20 bp, Artificial
  B2M gRNA target site sequence
agctgcgctgggggagccag

SEQ ID NO: 2511 - DNA, 20 bp, Artificial
  B2M gRNA target site sequence
gggagccagaggccccgcga

SEQ ID NO: 2512 - DNA, 20 bp, Artificial
  B2M gRNA target site sequence
gagccagaggccccgcgaaa

SEQ ID NO: 2513 - DNA, 20 bp, Artificial
  B2M gRNA target site sequence
ccagaggccccgcgaaagag

SEQ ID NO: 2514 - DNA, 20 bp, Artificial
  B2M gRNA target site sequence
gaggccccgcgaaagagcgg

SEQ ID NO: 2515 - DNA, 20 bp, Artificial
  B2M gRNA target site sequence
ggccccgcgaaagagcggaa

SEQ ID NO: 2516 - DNA, 20 bp, Artificial
  B2M gRNA target site sequence
gagaaaccctcccccaacct

SEQ ID NO: 2517 - DNA, 20 bp, Artificial
  B2M gRNA target site sequence
tcccgaccctcccgtcgccg

SEQ ID NO: 2518 - DNA, 20 bp, Artificial
  B2M gRNA target site sequence
cccgaccctcccgtcgccgt

SEQ ID NO: 2519 - DNA, 20 bp, Artificial
  B2M gRNA target site sequence
cctcccgtcgccgtaggcca

SEQ ID NO: 2520 - DNA, 20 bp, Artificial
  B2M gRNA target site sequence
ctcccgtcgccgtaggccaa

SEQ ID NO: 2521 - DNA, 20 bp, Artificial
  B2M gRNA target site sequence
tctcccctgctccccgccga

SEQ ID NO: 2522 - DNA, 20 bp, Artificial
  B2M gRNA target site sequence
ctcccctgctccccgccgaa

SEQ ID NO: 2523 - DNA, 20 bp, Artificial
  B2M gRNA target site sequence
tcccctgctccccgccgaaa

SEQ ID NO: 2524 - DNA, 20 bp, Artificial
  B2M gRNA target site sequence
cccctgctccccgccgaaag

SEQ ID NO: 2525 - DNA, 20 bp, Artificial
  B2M gRNA target site sequence
tgctccccgccgaaaggggc

SEQ ID NO: 2526 - DNA, 20 bp, Artificial
  B2M gRNA target site sequence
tccccgccgaaaggggcaag

SEQ ID NO: 2527 - DNA, 20 bp, Artificial
  B2M gRNA target site sequence
ggggcaagtagcgcgcgtcc

SEQ ID NO: 2528 - DNA, 20 bp, Artificial
  B2M gRNA target site sequence
gggcaagtagcgcgcgtccc

SEQ ID NO: 2529 - DNA, 20 bp, Artificial
  B2M gRNA target site sequence
cgcacccccttccccactcc

SEQ ID NO: 2530 - DNA, 20 bp, Artificial
  B2M gRNA target site sequence
gcacccccttccccactccc

SEQ ID NO: 2531 - DNA, 20 bp, Artificial
  B2M gRNA target site sequence
ggccaccccgccgcttcccc

SEQ ID NO: 2532 - DNA, 20 bp, Artificial
  B2M gRNA target site sequence
cccgccgcttccccgagatc

SEQ ID NO: 2533 - DNA, 20 bp, Artificial
  B2M gRNA target site sequence
gcttccccgagatccagccc

SEQ ID NO: 2534 - DNA, 20 bp, Artificial
  B2M gRNA target site sequence
cccgagatccagccctggac

SEQ ID NO: 2535 - DNA, 20 bp, Artificial
  B2M gRNA target site sequence
ccagccctggactagcccca

SEQ ID NO: 2536 - DNA, 20 bp, Artificial
  B2M gRNA target site sequence
gccctggactagccccacgg

SEQ ID NO: 2537 - DNA, 20 bp, Artificial
  B2M gRNA target site sequence
ccctggactagccccacggc

SEQ ID NO: 2538 - DNA, 20 bp, Artificial
  B2M gRNA target site sequence
tagccccacggcgggccacc

SEQ ID NO: 2539 - DNA, 20 bp, Artificial
  B2M gRNA target site sequence
agccccacggcgggccacca

SEQ ID NO: 2540 - DNA, 20 bp, Artificial
  B2M gRNA target site sequence
ccccacggcgggccaccaag

SEQ ID NO: 2541 - DNA, 20 bp, Artificial
  B2M gRNA target site sequence
gcgggccaccaaggagaact

SEQ ID NO: 2542 - DNA, 20 bp, Artificial
  B2M gRNA target site sequence
gggccaccaaggagaacttg

SEQ ID NO: 2543 - DNA, 20 bp, Artificial
  B2M gRNA target site sequence
ccaccaaggagaacttggag

SEQ ID NO: 2544 - DNA, 20 bp, Artificial
  B2M gRNA target site sequence
caccaaggagaacttggaga

SEQ ID NO: 2545 - DNA, 20 bp, Artificial
  B2M gRNA target site sequence
accaaggagaacttggagaa

SEQ ID NO: 2546 - DNA, 20 bp, Artificial
  B2M gRNA target site sequence
aaggagaacttggagaaggg

SEQ ID NO: 2547 - DNA, 20 bp, Artificial
  B2M gRNA target site sequence
aacttggagaagggaagtca

SEQ ID NO: 2548 - DNA, 20 bp, Artificial
  B2M gRNA target site sequence
cttggagaagggaagtcacg

SEQ ID NO: 2549 - DNA, 20 bp, Artificial
  B2M gRNA target site sequence
gagaagggaagtcacggagc

SEQ ID NO: 2550 - DNA, 20 bp, Artificial
  B2M gRNA target site sequence
gaagggaagtcacggagcga

SEQ ID NO: 2551 - DNA, 20 bp, Artificial
  B2M gRNA target site sequence
agggaagtcacggagcgaga

SEQ ID NO: 2552 - DNA, 20 bp, Artificial
  B2M gRNA target site sequence
agtcacggagcgagagagca

SEQ ID NO: 2553 - DNA, 20 bp, Artificial
  B2M gRNA target site sequence
acggagcgagagagcacagc

SEQ ID NO: 2554 - DNA, 20 bp, Artificial
  B2M gRNA target site sequence
cggagcgagagagcacagcg

SEQ ID NO: 2555 - DNA, 20 bp, Artificial
  B2M gRNA target site sequence
ggagcgagagagcacagcga

SEQ ID NO: 2556 - DNA, 20 bp, Artificial
  B2M gRNA target site sequence
agagagcacagcgagggcca

SEQ ID NO: 2557 - DNA, 20 bp, Artificial
  B2M gRNA target site sequence
agagcacagcgagggccaca

SEQ ID NO: 2558 - DNA, 20 bp, Artificial
  B2M gRNA target site sequence
gagcacagcgagggccacag

SEQ ID NO: 2559 - DNA, 20 bp, Artificial
  B2M gRNA target site sequence
agcacagcgagggccacaga

SEQ ID NO: 2560 - DNA, 20 bp, Artificial
  B2M gRNA target site sequence
agcgagggccacagagggtg

SEQ ID NO: 2561 - DNA, 20 bp, Artificial
  B2M gRNA target site sequence
cgagggccacagagggtgca

SEQ ID NO: 2562 - DNA, 20 bp, Artificial
  B2M gRNA target site sequence
gggccacagagggtgcagag

SEQ ID NO: 2563 - DNA, 20 bp, Artificial
  B2M gRNA target site sequence
ggccacagagggtgcagagc

SEQ ID NO: 2564 - DNA, 20 bp, Artificial
  B2M gRNA target site sequence
ccacagagggtgcagagcgg

SEQ ID NO: 2565 - DNA, 20 bp, Artificial
  B2M gRNA target site sequence
acagagggtgcagagcggga

SEQ ID NO: 2566 - DNA, 20 bp, Artificial
  B2M gRNA target site sequence
cagagggtgcagagcgggag

SEQ ID NO: 2567 - DNA, 20 bp, Artificial
  B2M gRNA target site sequence
agggtgcagagcgggagagg

SEQ ID NO: 2568 - DNA, 20 bp, Artificial
  B2M gRNA target site sequence
gggtgcagagcgggagagga

SEQ ID NO: 2569 - DNA, 20 bp, Artificial
  B2M gRNA target site sequence
cagagcgggagaggaaggac

SEQ ID NO: 2570 - DNA, 20 bp, Artificial
  B2M gRNA target site sequence
gagcgggagaggaaggacca

SEQ ID NO: 2571 - DNA, 20 bp, Artificial
  B2M gRNA target site sequence
cgggagaggaaggaccagag

SEQ ID NO: 2572 - DNA, 20 bp, Artificial
  B2M gRNA target site sequence
gggagaggaaggaccagagc

SEQ ID NO: 2573 - DNA, 20 bp, Artificial
  B2M gRNA target site sequence
gagaggaaggaccagagcgg

SEQ ID NO: 2574 - DNA, 20 bp, Artificial
  B2M gRNA target site sequence
agaggaaggaccagagcggg

SEQ ID NO: 2575 - DNA, 20 bp, Artificial
  B2M gRNA target site sequence
gaggaaggaccagagcggga

SEQ ID NO: 2576 - DNA, 20 bp, Artificial
  B2M gRNA target site sequence
gaaggaccagagcgggaggg

SEQ ID NO: 2577 - DNA, 20 bp, Artificial
  B2M gRNA target site sequence
aaggaccagagcgggagggt

SEQ ID NO: 2578 - DNA, 20 bp, Artificial
  B2M gRNA target site sequence
ggaccagagcgggagggtag

SEQ ID NO: 2579 - DNA, 20 bp, Artificial
  B2M gRNA target site sequence
accagagcgggagggtagga

SEQ ID NO: 2580 - DNA, 20 bp, Artificial
  B2M gRNA target site sequence
agggtaggagagactcacgc

SEQ ID NO: 2581 - DNA, 20 bp, Artificial
  B2M gRNA target site sequence
taggagagactcacgctgga

SEQ ID NO: 2582 - DNA, 20 bp, Artificial
  B2M gRNA target site sequence
gactcacgctggatagcctc

SEQ ID NO: 2583 - DNA, 20 bp, Artificial
  B2M gRNA target site sequence
actcacgctggatagcctcc

SEQ ID NO: 2584 - DNA, 20 bp, Artificial
  B2M gRNA target site sequence
acgctggatagcctccaggc

SEQ ID NO: 2585 - DNA, 20 bp, Artificial
  B2M gRNA target site sequence
tggatagcctccaggccaga

SEQ ID NO: 2586 - DNA, 20 bp, Artificial
  B2M gRNA target site sequence
gatagcctccaggccagaaa

SEQ ID NO: 2587 - DNA, 20 bp, Artificial
  B2M gRNA target site sequence
tagcctccaggccagaaaga

SEQ ID NO: 2588 - DNA, 20 bp, Artificial
  B2M gRNA target site sequence
gcctccaggccagaaagaga

SEQ ID NO: 2589 - DNA, 20 bp, Artificial
  B2M gRNA target site sequence
tccaggccagaaagagagag

SEQ ID NO: 2590 - DNA, 20 bp, Artificial
  B2M gRNA target site sequence
ccagaaagagagagtagcgc

SEQ ID NO: 2591 - DNA, 20 bp, Artificial
  B2M gRNA target site sequence
aagagagagtagcgcgagca

SEQ ID NO: 2592 - DNA, 20 bp, Artificial
  B2M gRNA target site sequence
agagtagcgcgagcacagct

SEQ ID NO: 2593 - DNA, 20 bp, Artificial
  B2M gRNA target site sequence
gagtagcgcgagcacagcta

SEQ ID NO: 2594 - DNA, 20 bp, Artificial
  B2M gRNA target site sequence
cgcgagcacagctaaggcca

SEQ ID NO: 2595 - DNA, 20 bp, Artificial
  B2M gRNA target site sequence
cgagcacagctaaggccacg

SEQ ID NO: 2596 - DNA, 20 bp, Artificial
  B2M gRNA target site sequence
cacagctaaggccacggagc

SEQ ID NO: 2597 - DNA, 20 bp, Artificial
  B2M gRNA target site sequence
ggccacggagcgagacatct

SEQ ID NO: 2598 - DNA, 20 bp, Artificial
  B2M gRNA target site sequence
catctcggcccgaatgctgt

SEQ ID NO: 2599 - DNA, 20 bp, Artificial
  B2M gRNA target site sequence
ggcccgaatgctgtcagctt

SEQ ID NO: 2600 - DNA, 20 bp, Artificial
  B2M gRNA target site sequence
gcccgaatgctgtcagcttc

SEQ ID NO: 2601 - DNA, 20 bp, Artificial
  B2M gRNA target site sequence
tcagcttcaggaatgcccgc

SEQ ID NO: 2602 - DNA, 20 bp, Artificial
  B2M gRNA target site sequence
acttatattaaacgcgtgcc

SEQ ID NO: 2603 - DNA, 20 bp, Artificial
  B2M gRNA target site sequence
taaacgcgtgcccagccaat

SEQ ID NO: 2604 - DNA, 20 bp, Artificial
  B2M gRNA target site sequence
aaacgcgtgcccagccaatc

SEQ ID NO: 2605 - DNA, 20 bp, Artificial
  B2M gRNA target site sequence
cgtgcccagccaatcaggac

SEQ ID NO: 2606 - DNA, 20 bp, Artificial
  B2M gRNA target site sequence
gtgcccagccaatcaggaca

SEQ ID NO: 2607 - DNA, 20 bp, Artificial
  B2M gRNA target site sequence
gccaatcaggacaaggcccg

SEQ ID NO: 2608 - DNA, 20 bp, Artificial
  B2M gRNA target site sequence
ccaatcaggacaaggcccgc

SEQ ID NO: 2609 - DNA, 20 bp, Artificial
  B2M gRNA target site sequence
caatcaggacaaggcccgca

SEQ ID NO: 2610 - DNA, 20 bp, Artificial
  Cpf1 crRNA sequence
atataagtggaggcgtcgcg

SEQ ID NO: 2611 - DNA, 20 bp, Artificial
  Cpf1 crRNA sequence
tggcctggaggctatccagc

SEQ ID NO: 2612 - DNA, 20 bp, Artificial
  Cpf1 crRNA sequence
atgttatgaaaaaaatcagg

SEQ ID NO: 2613 - DNA, 24 bp, Artificial
  Cpf1 primer
gagggcctatttcccatgattcct

SEQ ID NO: 2614 - DNA, 66 bp, Artificial
  Cpf1 primer
cctttattttagctgaagggaaaatctacaagagtagaaattacggtgtttcgtcctttccacaag

SEQ ID NO: 2615 - DNA, 59 bp, Artificial
  target sequence
tggccttagctgtgctcgcgctactctctctttctggcctggaggctatccagcgtgag

SEQ ID NO: 2616 - DNA, 27 bp, Artificial
  target sequence
tggccttagctgtgctcgcgctactct

SEQ ID NO: 2617 - DNA, 12 bp, Artificial
  target sequence
atccagcgtgag

SEQ ID NO: 2618 - DNA, 27 bp, Artificial
  target sequence
tggccttagctgtgctcgcgctactct

SEQ ID NO: 2619 - DNA, 14 bp, Artificial
  target sequence
ctatccagcgtgag

SEQ ID NO: 2620 - DNA, 26 bp, Artificial
  target sequence
tggccttagctgtgctcgcgctactc

SEQ ID NO: 2621 - DNA, 30 bp, Artificial
  target sequence
ctttctggcctggaggctatccagcgtgag

SEQ ID NO: 2622 - DNA, 27 bp, Artificial
  target sequence
tggccttagctgtgctcgcgctactct

SEQ ID NO: 2623 - DNA, 24 bp, Artificial
  target sequence
ggcctggaggctatccagcgtgag

What is claimed is:

1. An isolated primary human cell or population of primary human cells comprising a genome in which the β2-microglobulin (B2M) gene on chromosome 15 has been edited to delete a contiguous stretch of genomic DNA consisting of the nucleotide sequence as set forth in SEQ ID NO: 1, wherein the contiguous stretch of genomic DNA is deleted between a first human B2M gene target site complementary to a nucleotide sequence consisting of SEQ ID NO: 16 and a second human B2M gene target site complementary to a nucleotide sequence consisting of SEQ ID NO: 21, wherein the isolated primary human cell or population of primary human cells are selected from the group consisting of a T cell and a CD34$^+$ cell, thereby eliminating surface expression of MHC Class I molecules in the cell or population of cells.

2. The cell or population of cells of claim 1, wherein the cell or population of cells is obtained from a subject suffering from, being treated for, diagnosed with, at risk of developing, or suspected of having, a disorder selected from the group consisting of a genetic disorder, an infection, and cancer.

3. The cell or population of cells of claim 2, wherein the disorder HIV or AIDs.

4. The cell or population of cells of claim 1, wherein the cell or population of cells are CD4$^+$ T cells.

5. The cell or population of cells of claim 1, wherein the cell or population of cells are CD34$^+$ cells.

6. The cell or population of cells of claim 1, wherein the cell or population of cells is obtained from a subject suffering from or diagnosed with cancer.

7. The cell or population of cells of claim 1, wherein the cell or population of cells is obtained from a subject being treated for cancer.

8. The cell or population of cells of claim 1, wherein the cell or population of cells is obtained from a healthy subject.

\* \* \* \* \*

UNITED STATES PATENT AND TRADEMARK OFFICE
CERTIFICATE OF CORRECTION

| | | |
|---|---|---|
| PATENT NO. | : 12,180,263 B2 | Page 1 of 1 |
| APPLICATION NO. | : 15/524968 | |
| DATED | : December 31, 2024 | |
| INVENTOR(S) | : Chad A. Cowan et al. | |

It is certified that error appears in the above-identified patent and that said Letters Patent is hereby corrected as shown below:

In the Claims

Claim 3, Column 62, Lines 17-18: "the disorder HIV or AIDS" should read --the disorder is HIV or AIDS--

Signed and Sealed this
Eighteenth Day of February, 2025

Coke Morgan Stewart
*Acting Director of the United States Patent and Trademark Office*